United States Patent
Johnson et al.

(10) Patent No.: US 12,421,311 B2
(45) Date of Patent: Sep. 23, 2025

(54) ANTI-CTLA-4 BINDING PROTEINS AND METHODS OF USE THEREOF

(71) Applicant: GigaGen, Inc., San Carlos, CA (US)

(72) Inventors: David Scott Johnson, San Francisco, CA (US); Adam Shultz Adler, Belmont, CA (US); Rena Aviva Mizrahi, Pacifica, CA (US); Yoong Wearn Lim, Pacifica, CA (US); Michael Asensio, Mountain View, CA (US); Erica Lyn Stone, San Bruno, CA (US)

(73) Assignee: GigaGen, Inc., San Carlos, CA (US)

( * ) Notice: Subject to any disclaimer, the term of this patent is extended or adjusted under 35 U.S.C. 154(b) by 1065 days.

(21) Appl. No.: 17/418,776

(22) PCT Filed: Dec. 27, 2019

(86) PCT No.: PCT/US2019/068820
§ 371 (c)(1),
(2) Date: Jun. 25, 2021

(87) PCT Pub. No.: WO2020/140084
PCT Pub. Date: Jul. 2, 2020

(65) Prior Publication Data
US 2022/0064303 A1  Mar. 3, 2022

Related U.S. Application Data

(60) Provisional application No. 62/785,659, filed on Dec. 27, 2018.

(51) Int. Cl.
*C07K 16/28* (2006.01)
*A61P 35/00* (2006.01)
*A61K 39/00* (2006.01)

(52) U.S. Cl.
CPC .......... *C07K 16/2818* (2013.01); *A61P 35/00* (2018.01); *A61K 2039/505* (2013.01); *C07K 2317/33* (2013.01); *C07K 2317/622* (2013.01); *C07K 2317/73* (2013.01); *C07K 2317/76* (2013.01); *C07K 2317/92* (2013.01)

(58) Field of Classification Search
None
See application file for complete search history.

(56) References Cited

U.S. PATENT DOCUMENTS

| | | | |
|---|---|---|---|
| 6,984,720 B1 * | 1/2006 | Korman | A61P 31/18 530/387.9 |
| 9,714,290 B2 | 7/2017 | Jones et al. | |
| 2002/0086014 A1 | 7/2002 | Korman et al. | |
| 2011/0166335 A1 | 7/2011 | Corbin et al. | |
| 2013/0136749 A1 | 5/2013 | Medarex | |
| 2014/0105914 A1 | 4/2014 | Jones et al. | |
| 2019/0202917 A1 | 7/2019 | Campbell et al. | |
| 2020/0197518 A1 | 6/2020 | Sadineni et al. | |

FOREIGN PATENT DOCUMENTS

| | | | | |
|---|---|---|---|---|
| EP | 3256165 B1 | 7/2021 | | |
| WO | WO-2004035603 A2 * | 4/2004 | ......... | C07K 16/2863 |
| WO | WO 2006/029219 A2 | 3/2006 | | |
| WO | WO 2014/089113 A1 | 6/2014 | | |
| WO | WO 2015/092393 A2 | 6/2015 | | |
| WO | WO 2015/187835 A2 | 12/2015 | | |
| WO | WO 2016/130898 A2 | 8/2016 | | |
| WO | WO 2016/130986 A1 | 8/2016 | | |
| WO | WO 2017/106372 A1 | 6/2017 | | |
| WO | WO 2017/194265 A1 | 11/2017 | | |
| WO | WO 2018/025178 A1 | 2/2018 | | |
| WO | WO 2018/157147 A1 | 8/2018 | | |
| WO | WO 2018/209701 A1 | 11/2018 | | |
| WO | WO 2019/023482 A1 | 1/2019 | | |
| WO | WO 2020/140084 A1 | 7/2020 | | |
| WO | WO 2020/154189 A1 | 7/2020 | | |
| WO | WO 2022/006557 A2 | 1/2022 | | |

OTHER PUBLICATIONS

How is Alzheimer's Disease Treated?, Sep. 12, 2023, NIH—National Institute on Aging, https://www.nia.nih.gov/health/alzheimers-treatment/how-alzheimers-disease-treated. (Year: 2023).*
HIV Overview, HIV Treatment: The Basics, Sep. 4, 2024, NIH, https://hivinfo.nih.gov/understanding-hiv/fact-sheets/hiv-and-aids-basics. (Year: 2024).*
Chen et al., Generation and analysis of random point mutations in an antibody CDR2 sequence: many mutated antibodies lose their ability to bind, 1992, Journal of Experimental Medicine, 176: 855-866. (Year: 1992).*
MacCallum et al., Antibody-antigen interactions: contact analysis and binding site topography; 1996, J. Mol. Biol., 262: 732-745. (Year: 1996).*
Koenig et al., Mutational landscape of antibody variable domains reveals a switch modulating the interdomain conformational dynamics and antigen binding; 2017, PNAS, 114(4): E486-495. (Year: 2017).*
Rock et al., CDR3 length in antigen-specific immune receptors, 1994, Journal of Experimental Medicine, 179: 323-328. (Year: 1994).*

(Continued)

*Primary Examiner* — Daniel E Kolker
*Assistant Examiner* — James Ryland Melchior
(74) *Attorney, Agent, or Firm* — Fenwick & West LLP

(57) ABSTRACT

Provided herein are antigen-binding proteins (ABPs) that selectively bind to CTLA-4 and its isoforms and homologs, and compositions comprising the ABPs. Also provided are methods of using the ABPs, such as therapeutic and diagnostic methods.

Figure 1:
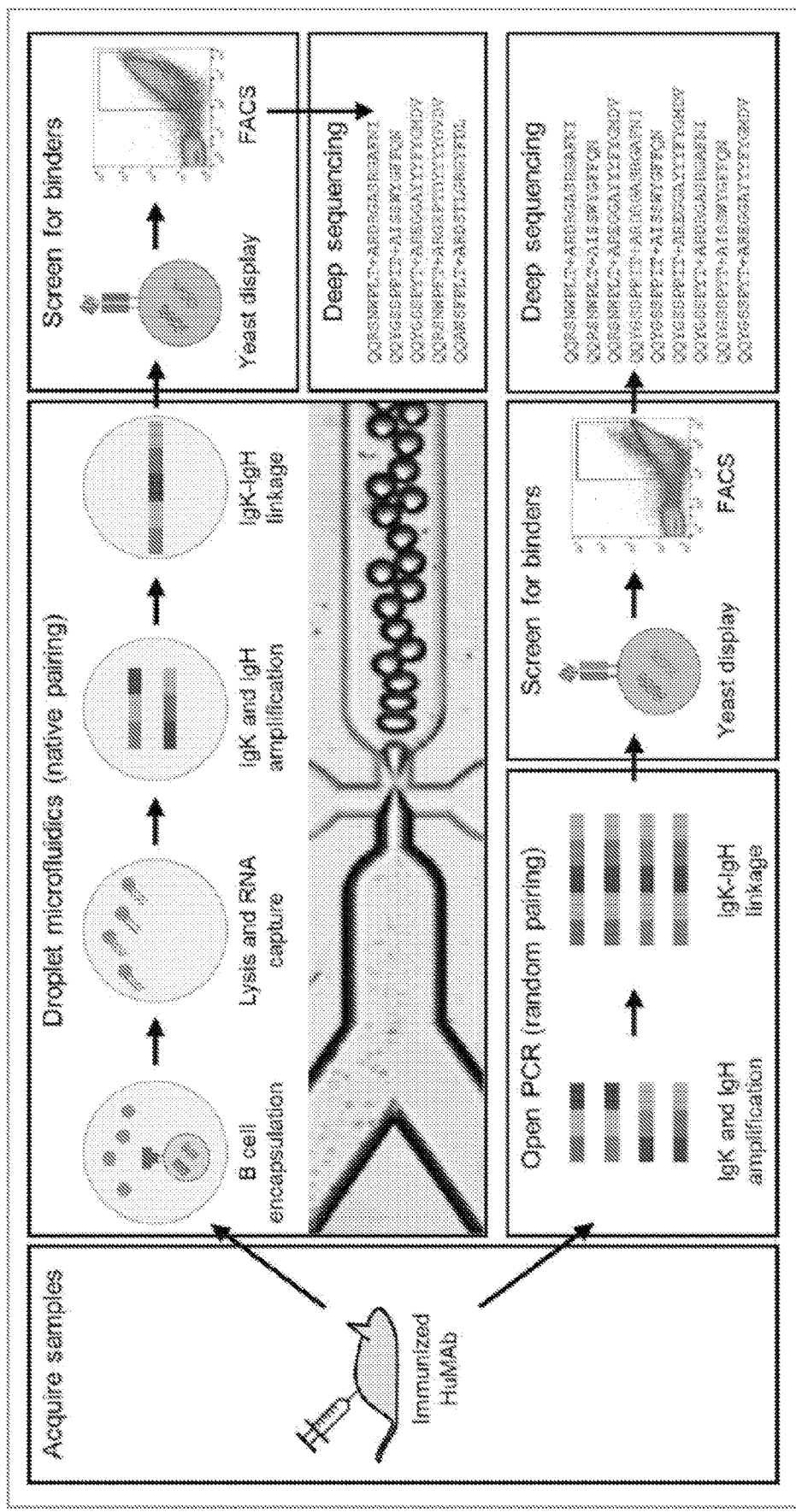

14 Claims, 11 Drawing Sheets
Specification includes a Sequence Listing.

(56) References Cited

OTHER PUBLICATIONS

Dondelinger et al., Understanding the significance and implications of antibody numbering and antigen-binding surface/residue definition, 2018, Frontiers in Immunology, 9(2278): 1-15. (Year: 2018).*

Martins et al., Adverse effects of immune-checkpoint inhibitors: epidemiology, management and surveillance, 2019, Nature Reviews Clinical Oncology, 16: 563-580. (Year: 2019).*

Stone et al., "Lack of blocking activity in anti-CTLA-4 antibodies reduces toxicity, but not anti-tumor efficacy," bioRxiv preprint, Jul. 12, 2021, pp. 1-62.

Asensio, M., et al., "Antibody repertoire analysis of mouse immunization protocols using microfluidics and molecular genomics", MABS, 2019, vol. 11, No. 5, pp. 870-883, https://doi.org/10.1080/19420862.2019.1583995.

Extended European Search Report, European Patent Office Application No. 19902920.8, Oct. 28, 2022, 14 pages.

He, M. et al., "Remarkably similar CTLA-4 binding properties of therapeutic ipilimumab and tremelimumab antibodies," Oncotarget, May 19, 2017, vol. 8, No. 40, pp. 67129-67139; Table 2; DOI: 10.18632/oncotarget.18004.

International Search Report and Written Opinion, Patent Cooperation Treaty Application No. PCT/US2021/040379, Dec. 30, 2021, 33 pages.

International Search Report and Written Opinion, Patent Cooperation Treaty Application No. PCT/US2022/073318, Oct. 4, 2022, 19 pages.

Partial Supplementary European Search Report, European Patent Office Application No. 19902920.8, Aug. 19, 2022, 16 pages.

PCT International Search Report and Written Opinion, International Application No. PCT/US2019/068820, dated May 20, 2020, 12 pages.

European Patent Office, Extended European Search Report and Opinion, EP Patent Application No. 21833742.6, Jun. 25, 2024, 14 pages.

McGary, C.S. et al., "CTLA-4+PD-1 memory CD4+ T cells critically contribute to viral persistence in antiretroviral therapy-suppressed, SIV-infected rhesus macaques," Immunity 47(4), Oct. 17, 2017, pp. 776-788.

Weber, J., "Review: Anti-CTLA-4 Antibody Ipilimumab: Case Studies of Clinical Response and Immune-Related Adverse Events," The Oncologist, vol. 12, Dec. 31, 2007, pp. 864-872.

Zuo, Q-Z. et al., "Progress of CTLA-4 and PD-1 signaling pathways in immunotherapy for human solid cancers," Chinese Bulletin of Life Sciences, vol. 29, No. 8, Aug. 2017, pp. 713-721 (with English abstract).

* cited by examiner

ANTI-CTLA-4 BINDING PROTEINS AND METHODS OF USE THEREOF

1. CROSS REFERENCE TO RELATED APPLICATIONS

This application is the National Stage of International Application No. PCT/US2019/068820, filed Dec. 27, 2019, which claims priority to and benefit of U.S. Provisional Patent Application No. 62/785,659, filed Dec. 27, 2018, the entire contents of which are incorporated reference herein.

2. SEQUENCE LISTING

The instant application contains a Sequence Listing with 11998 sequences which has been submitted via EFS-Web and is hereby incorporated by reference in its entirety. Said ASCII copy, created on Dec. 20, 2019, is named GGN-010WO_SL.txt, and is 1,927,908 bytes in size.

3. FIELD

Provided herein are antigen-binding proteins (ABPs) with binding specificity for CTLA-4 and compositions comprising such ABPs, including pharmaceutical compositions, diagnostic compositions, and kits. Also provided are methods of making CTLA-4 ABPs, and methods of using CTLA-4 ABPs, for example, for therapeutic purposes, diagnostic purposes, and research purposes.

4. BACKGROUND

CTLA-4, also known as cytotoxic T-lymphocyte associated protein 4 and CD152 (cluster of differentiation 152), is a cell surface receptor that suppresses T cell inflammatory activity. CTLA-4 is constitutively expressed by regulatory T cells (Tregs) and upregulated in stimulated T cells. CD80 and CD86, also expressed in antigen presenting cells (APCs) such as dendritic cells (DCs), are the primary ligands of CTLA-4. The interaction between CTLA-4 and its ligands is vitally important for downregulating the immune responses and promoting self-tolerance by suppressing T cell inflammatory activity. This activity prevents autoimmune diseases, as well as prevents the immune system from killing cancer cells.

CTLA-4 is a member of the immunoglobulin superfamily that is expressed by activated T cells and transmits an inhibitory signal to T cells. CTLA-4 binds CD80 and CD86 with greater affinity and avidity than CD28 thus enabling it to outcompete CD28 for its ligands. CTLA-4 transmits an inhibitory signal to T cells, whereas CD28 transmits a stimulatory signal. CTLA-4 is also found in regulatory T cells (Tregs) and contributes to their inhibitory function. T cell activation through the T cell receptor and CD28 leads to increased expression of CTLA-4. The mechanism by which CTLA-4 acts in T cells remains somewhat controversial. Biochemical evidence suggested that CTLA-4 recruits a phosphatase to the T cell receptor (TCR), thus attenuating the signal. This work remains unconfirmed in the literature since its first publication. More recent work has suggested that CTLA-4 may function in vivo by capturing and removing B7-1 and B7-2 from the membranes of antigen-presenting cells, thus making these unavailable for triggering of CD28.

Variants in CTLA-4 have been associated with insulin-dependent diabetes mellitus, Graves' disease, Hashimoto's thyroiditis, celiac disease, systemic lupus erythematosus, thyroid-associated orbitopathy, primary biliary cirrhosis and other autoimmune diseases. The comparatively high binding affinity of CTLA-4 for CD80 and CD86 has made it a potential therapy for autoimmune diseases. Soluble fusion proteins of CTLA-4 and antibodies (CTLA-4-Ig) have been used in clinical trials for rheumatoid arthritis.

Tumor cells suppress anti-tumor immune response through various mechanisms, including up-regulation of Tregs. Recently, CTLA-4 inhibitors have been shown to antagonize binding of CTLA-4 to its ligands, thereby activating the immune system to attack tumors. CTLA-4 antibodies have also been used to induce antibody-dependent cell-mediated cytotoxicity (ADCC) of Tregs specific to the tumor microenvironment, thus reducing immune tolerance to the tumor. CTLA-4 antibodies have been therefore used with varying success to treat some types of cancer.

Thus, there is a need for developing CTLA-4 ABPs that can be used for treatment, diagnosis, and research of various diseases, including cancer and autoimmune disease.

5. SUMMARY

Provided herein are novel ABPs with binding specificity for CTLA-4 and methods of using such ABPs. The CTLA-4 is a human CTLA-4 (SEQ ID: 7001) or a fragment of the human CTLA-4.

The ABP can comprise an antibody. In some embodiments, the antibody is a monoclonal antibody. In some embodiments, the antibody is a chimeric antibody. In some embodiments, the antibody is a humanized antibody. In some embodiments, the antibody is a human antibody. In some embodiments, the ABP comprises an antibody fragment. In some embodiments, the ABP comprises an alternative scaffold. In some embodiments, the ABPs comprises a single-chain variable fragment (scFv).

The ABPs provided herein can induce various biological effects associated with inhibition or activation of CTLA-4. In some embodiments, an ABP provided herein prevents binding between CTLA-4 and its ligands. In some embodiments, an ABP provided herein prevents inhibition of an effector T cell by a Treg. In some embodiments, the ABP directly kills or induces killing of Tregs or other CTLA-4-expressing cells in the tumor microenvironment by ADCC and/or ADCP, for example mediated by binding of NK cell-expressed CD16 to the ABP Fc domain. In some embodiments, the ABP inhibits the suppression of an effector T cell by a regulatory T cell by directly killing Tregs. In some embodiments, the tissue is a tumor. In some embodiments, the ABP activates CTLA-4, leading to Treg expansion and activation.

Also provided are kits comprising one or more of the pharmaceutical compositions comprising the ABPs, and instructions for use of the pharmaceutical composition.

Also provided are isolated polynucleotides encoding the ABPs provided herein, and portions thereof.

Also provided are vectors comprising such polynucleotides.

Also provided are recombinant host cells comprising such polynucleotides and recombinant host cells comprising such vectors.

Also provided are methods of producing the ABP using the polynucleotides, vectors, or host cells provided herein.

Also provided are pharmaceutical compositions comprising the ABPs and a pharmaceutically acceptable excipient.

Also provided are methods of treating or preventing a disease or condition in a subject in need thereof, comprising administering to the subject an effective amount of an ABP provided herein, or a pharmaceutical composition comprising such ABP. In some aspects, the disease or condition is a cancer or autoimmune disease. In some aspects, the disease or condition is a viral or bacterial infection. In some aspects the method further comprises administering one or more additional therapeutic agents. In some aspects, the additional therapeutic agent is an immune stimulatory agent.

More specifically, the present disclosure provides an isolated antigen binding protein (ABP) that specifically binds a human cytotoxic T-lymphocyte associated protein 4 (CTLA-4), comprising: (a) a CDR3-L having a sequence selected from SEQ ID NOS: 3001-3028 and a CDR3-H having a sequence selected from SEQ ID NOS: 6001-6028; or (b) a CDR3-L having a sequence selected from SEQ ID NOS: 9984-10479 and a CDR3-H having a sequence selected from SEQ ID NOS: 11472-11967; or (c) a CDR3-L having a sequence of the CD3-L of any one of the clones in the library deposited under ATCC Accession No. PTA-125512 and a CDR3-L having a sequence of the CD3-L of any one of the clones in the library deposited under ATCC Accession No. PTA-125512. In some embodiments, the CDR3-L and the CDR3-H are a cognate pair.

In some embodiments, the ABP comprises (a) a CDR1-L having a sequence selected from SEQ ID NOS: 1001-1028 and a CDR2-L having a sequence selected from SEQ ID NOS: 2001-2028; and a CDR1-H having a sequence selected from SEQ ID NOS: 4001-4028; and a CDR2-H having a sequence selected from SEQ ID NOS: 5001-5028; or (b) a CDR1-L having a sequence selected from SEQ ID NOS: 8992-9487; and a CDR2-L having a sequence selected from SEQ ID NOS: 9488-9983; and a CDR1-H having a sequence selected from SEQ ID NOS: 10480-10975; and a CDR2-H having a sequence selected from SEQ ID NOS: 10976-11471; or (c) a CDR1-L having a sequence selected from a CDR1-L of any one of the clones in the library deposited under ATCC Accession No. PTA-125512; and a CDR2-L having a sequence selected from a CDR2-L of any one of the clones in the library deposited under ATCC Accession No. PTA-125512; and a CDR1-H having a sequence selected from a CDR1-H of any one of the clones in the library deposited under ATCC Accession No. PTA-125512; and a CDR2-H having a sequence selected from a CDR2-H of any one of the clones in the library deposited under ATCC Accession No. PTA-125512;

In some embodiments, the ABP comprises a CDR1-L, a CDR2-L, a CDR3-L, a CDR1-H, a CDR2-H and a CDR3-H, wherein the CDR1-L consists of SEQ ID NO: 1001, the CDR2-L consists of SEQ ID NO: 2001, the CDR3-L consists of SEQ ID NO: 3001, the CDR1-H consists of SEQ ID NO: 4001, the CDR2-H consists of SEQ ID NO: 5001 and the CDR3-H consists of SEQ ID NO: 6001; or the CDR1-L consists of SEQ ID NO: 1002, CDR2-L consists of SEQ ID NO: 2002, the CDR3-L consists of SEQ ID NO: 3002, the CDR1-H consists of SEQ ID NO: 4002, the CDR2-H consists of SEQ ID NO: 5002 and the CDR3-H consists of SEQ ID NO: 6002; or the CDR1-L consists of SEQ ID NO: 1003, the CDR2-L consists of SEQ ID NO: 2003, the CDR3-L consists of SEQ ID NO: 3003, the CDR1-H consists of SEQ ID NO: 4003, the CDR2-H consists of SEQ ID NO: 5003 and the CDR3-H consists of SEQ ID NO: 6003; or the CDR1-L consists of SEQ ID NO: 1004, the CDR2-L consists of SEQ ID NO: 2004, the CDR3-L consists of SEQ ID NO: 3004, the CDR1-H consists of SEQ ID NO: 4004, the CDR2-H consists of SEQ ID NO: 5004 and the CDR3-H consists of SEQ ID NO: 6004; or the CDR1-L consists of SEQ ID NO: 1005, the CDR2-L consists of SEQ ID NO: 2005, the CDR3-L consists of SEQ ID NO: 3005, the CDR1-H consists of SEQ ID NO: 4005, the CDR2-H consists of SEQ ID NO: 5005 and the CDR3-H consists of SEQ ID NO: 6005; or the CDR1-L consists of SEQ ID NO: 1006, the CDR2-L consists of SEQ ID NO: 2006, the CDR3-L consists of SEQ ID NO: 3006, the CDR1-H consists of SEQ ID NO: 4006, the CDR2-H consists of SEQ ID NO: 5006 and the CDR3-H consists of SEQ ID NO: 6006; or the CDR1-L consists of SEQ ID NO: 1007, the CDR2-L consists of SEQ ID NO: 2007, the CDR3-L consists of SEQ ID NO: 3007, the CDR1-H consists of SEQ ID NO: 4007, the CDR2-H consists of SEQ ID NO: 5007 and the CDR3-H consists of SEQ ID NO: 6007; or the CDR1-L consists of SEQ ID NO: 1008, the CDR2-L consists of SEQ ID NO: 2008, the CDR3-L consists of SEQ ID NO: 3008, the CDR1-H consists of SEQ ID NO: 4008, the CDR2-H consists of SEQ ID NO: 5008 and the CDR3-H consists of SEQ ID NO: 6008 or the CDR1-L consists of SEQ ID NO: 1009, the CDR2-L consists of SEQ ID NO: 2009, the CDR3-L consists of SEQ ID NO: 3009, the CDR1-H consists of SEQ ID NO: 4009, the CDR2-H consists of SEQ ID NO: 5009 and the CDR3-H consists of SEQ ID NO: 6009; or the CDR1-L consists of SEQ ID NO: 1010, the CDR2-L consists of SEQ ID NO: 2010, the CDR3-L consists of SEQ ID NO: 3010, the CDR1-H consists of SEQ ID NO: 4010, the CDR2-H consists of SEQ ID NO: 5010 and the CDR3-H consists of SEQ ID NO: 6010; or the CDR1-L consists of SEQ ID NO: 1011, the CDR2-L consists of SEQ ID NO: 2011, the CDR3-L consists of SEQ ID NO: 3011, the CDR1-H consists of SEQ ID NO: 4011, the CDR2-H consists of SEQ ID NO: 5011 and the CDR3-H consists of SEQ ID NO: 6011; or the CDR1-L consists of SEQ ID NO: 1012, the CDR2-L consists of SEQ ID NO: 2012, the CDR3-L consists of SEQ ID NO: 3012, the CDR1-H consists of SEQ ID NO: 4012, the CDR2-H consists of SEQ ID NO: 5012 and the CDR3-H consists of SEQ ID NO: 6012; or the CDR1-L consists of SEQ ID NO: 1013, the CDR2-L consists of SEQ ID NO: 2013, the CDR3-L consists of SEQ ID NO: 3013, the CDR1-H consists of SEQ ID NO: 4013, the CDR2-H consists of SEQ ID NO: 5013 and the CDR3-H consists of SEQ ID NO: 6013; or the CDR1-L consists of SEQ ID NO: 1014, the CDR2-L consists of SEQ ID NO: 2014, the CDR3-L consists of SEQ ID NO: 3014, the CDR1-H consists of SEQ ID NO: 4014, the CDR2-H consists of SEQ ID NO: 5014 and the CDR3-H consists of SEQ ID NO: 6014; or the CDR1-L consists of SEQ ID NO: 1015, the CDR2-L consists of SEQ ID NO: 2015, the CDR3-L consists of SEQ ID NO: 3015, the CDR1-H consists of SEQ ID NO: 4015, the CDR2-H consists of SEQ ID NO: 5015 and the CDR3-H consists of SEQ ID NO: 6015; or the CDR1-L consists of SEQ ID NO: 1016, the CDR2-L consists of SEQ ID NO: 2016, the CDR3-L consists of SEQ ID NO: 3016, the CDR1-H consists of SEQ ID NO: 4016, the CDR2-H consists of SEQ ID NO: 5016 and the CDR3-H consists of SEQ ID NO: 6016; or the CDR1-L consists of SEQ ID NO: 1017, the CDR2-L consists of SEQ ID NO: 2017, the CDR3-L consists of SEQ ID NO: 3017, the CDR1-H consists of SEQ ID NO: 4017, the CDR2-H consists of SEQ ID NO: 5017 and the CDR3-H consists of SEQ ID NO: 6017; or the CDR1-L consists of SEQ ID NO: 1018, the CDR2-L consists of SEQ ID NO: 2018, the CDR3-L consists of SEQ ID NO: 3018, the CDR1-H consists of SEQ ID NO: 4018, the CDR2-H consists of SEQ ID NO: 5018 and the CDR3-H consists of SEQ ID NO: 6018; or the CDR1-L consists of SEQ ID NO: 1019, the CDR2-L consists of SEQ ID NO: 2019, the CDR3-L consists of SEQ ID NO: 3019, the CDR1-H consists of SEQ ID NO: 4019, the CDR2-H consists of SEQ ID NO: 5019 and the CDR3-H consists of SEQ ID NO: 6019; or the CDR1-L consists of SEQ ID NO: 1020, the CDR2-L consists of SEQ ID NO: 2020, the CDR3-L consists of SEQ ID NO: 3020, the CDR1-H consists of SEQ ID NO: 4020, the CDR2-H consists of SEQ ID NO: 5020 and the CDR3-H consists of SEQ ID NO: 6020; or the CDR1-L consists of SEQ ID NO: 1021, the CDR2-L consists of SEQ ID NO: 2021, the CDR3-L consists of SEQ ID NO: 3021, the CDR1-H consists of SEQ ID NO: 4021, the CDR2-H consists of SEQ ID NO: 5021 and the CDR3-H consists of SEQ ID NO: 6021; or the CDR1-L consists of SEQ ID NO: 1022, the CDR2-L consists of SEQ ID NO: 2022, the CDR3-L consists of SEQ ID NO: 3022, the CDR1-H consists of SEQ ID NO: 4022, the CDR2-H consists of SEQ ID NO: 5022 and the CDR3-H consists of SEQ ID NO: 6022; or the CDR1-L consists of SEQ ID NO: 1023, the CDR2-L consists of SEQ ID NO: 2023, the CDR3-L consists of SEQ ID NO: 3023, the CDR1-H consists of SEQ ID NO: 4023, the CDR2-H consists of SEQ ID NO: 5023 and the CDR3-H consists of SEQ ID NO: 6023; or the CDR1-L consists of SEQ ID NO: 1024, the CDR2-L consists of SEQ ID NO: 2024, the CDR3-L consists of SEQ ID NO: 3024, the CDR1-H consists of SEQ ID NO: 4024, the CDR2-H consists of SEQ ID NO: 5024 and the CDR3-H consists of SEQ ID NO: 6024; or the CDR1-L consists of SEQ ID NO: 1025, the CDR2-L consists of SEQ ID NO: 2025, the CDR3-L consists of SEQ ID NO: 3025, the CDR1-H consists of SEQ ID NO: 4025, the CDR2-H consists of SEQ ID NO: 5025 and the CDR3-H consists of SEQ ID NO: 6025; or the CDR1-L consists of SEQ ID NO: 1026, the CDR2-L consists of SEQ ID NO: 2026, the CDR3-L consists of SEQ ID NO: 3026, the CDR1-H consists of SEQ ID NO: 4026, the CDR2-H consists of SEQ ID NO: 5026 and the CDR3-H consists of SEQ ID NO: 6026; or the CDR1-L consists of SEQ ID NO: 1027, the CDR2-L consists of SEQ ID NO: 2027, the CDR3-L consists of SEQ ID NO: 3027, the CDR1-H consists of SEQ ID NO: 4027, the CDR2-H consists of SEQ ID NO: 5027 and the CDR3-H consists of SEQ ID NO: 6027; or the CDR1-L consists of SEQ ID NO: 1028, the CDR2-L consists of SEQ ID NO: 2028, the CDR3-L consists of SEQ ID NO: 3028, the CDR1-H consists of SEQ ID NO: 4028, the CDR2-H consists of SEQ ID NO: 5028 and the CDR3-H consists of SEQ ID NO: 6028.

In some embodiments, the ABP comprises a variable light chain ($V_L$) comprising a sequence at least 97% identical to a sequence selected from SEQ ID NOS: 1-28 and a variable heavy chain ($V_H$) comprising a sequence at least 97% identical to a sequence selected from SEQ ID NOS: 101-128; or a variable light chain ($V_L$) comprising a sequence at least 97% identical to a sequence selected from SEQ ID NOS: 8000-8495 and a variable heavy chain ($V_H$) comprising a sequence at least 97% identical to a sequence selected from SEQ ID NOS: 8496-8991; or a variable light chain ($V_L$) comprising a sequence at least 97% identical to a $V_L$ sequence of any one of the clones in the library deposited under ATCC Accession No. PTA-125512 and a variable heavy chain ($V_H$) comprising a sequence at least 97% identical to a $V_H$ sequence of any one of the clones in the library deposited under ATCC Accession No. PTA-125512. In some embodiments, the $V_L$ and the $V_H$ are a cognate pair.

In some embodiments, the ABP comprises a variable light chain ($V_L$) comprising a sequence selected from SEQ ID NOS: 1-28 and a variable heavy chain ($V_H$) comprising a sequence selected from SEQ ID NOS: 101-128 or a variable light chain ($V_L$) comprising a sequence selected from SEQ ID NOS: 8000-8495 and a variable heavy chain ($V_H$) comprising a sequence selected from SEQ ID NOS: 8496-8991; or a variable light chain ($V_L$) comprising a $V_L$ sequence of any one of the clones in the library deposited under ATCC Accession No. PTA-125512 and a variable heavy chain ($V_H$) comprising a $V_H$ sequence of any one of the clones in the library deposited under ATCC Accession No. PTA-125512. In some embodiments, the $V_L$ and the $V_H$ are a cognate pair.

In some embodiments, the ABP comprises an scFv or a full length monoclonal antibody. In some embodiments, the ABP comprises an immunoglobulin constant region.

In some embodiments, the ABP binds human CTLA-4 with a $K_D$ of less than 500 nM, as measured by surface plasmon resonance. In some embodiments, the ABP binds human CTLA-4 with a $K_D$ of less than 200 nM, as measured by surface plasmon resonance. In some embodiments, the ABP binds human CTLA-4 with a $K_D$ of less than 25 nM, as measured by surface plasmon resonance. In some embodiments, the ABP binds to human CTLA-4 on a cell surface with a $K_D$ of less than 25 nM.

Another aspect of the present disclosure provides a method of treating a disease comprising the step of: administering to a subject in need thereof an effective amount of the ABP disclosed herein or the pharmaceutical composition disclosed herein. In some embodiments, the disease is selected from the group consisting of cancer, AIDS, Alzheimer's disease and viral or bacterial infection. In some embodiments, the method further comprises the step of administering one or more additional therapeutic agents to the subject. In some embodiments, the additional therapeutic agent is selected from CTLA-4 inhibitor, TIGIT inhibitor, a chemotherapy agent, an immune-stimulatory agent, radiation, a cytokine, a polynucleotide encoding a cytokine and a combination thereof.

6. BRIEF DESCRIPTION OF THE DRAWINGS

FIG. 1 summarized the method of generating scFv libraries from B cells isolated from fully human mice and selecting a B cell expressing an antibody having high-affinity to the antigen. FIG. 1 discloses SEQ ID NOS 11971-11998, respectively, in order of appearance.

Figure 2:
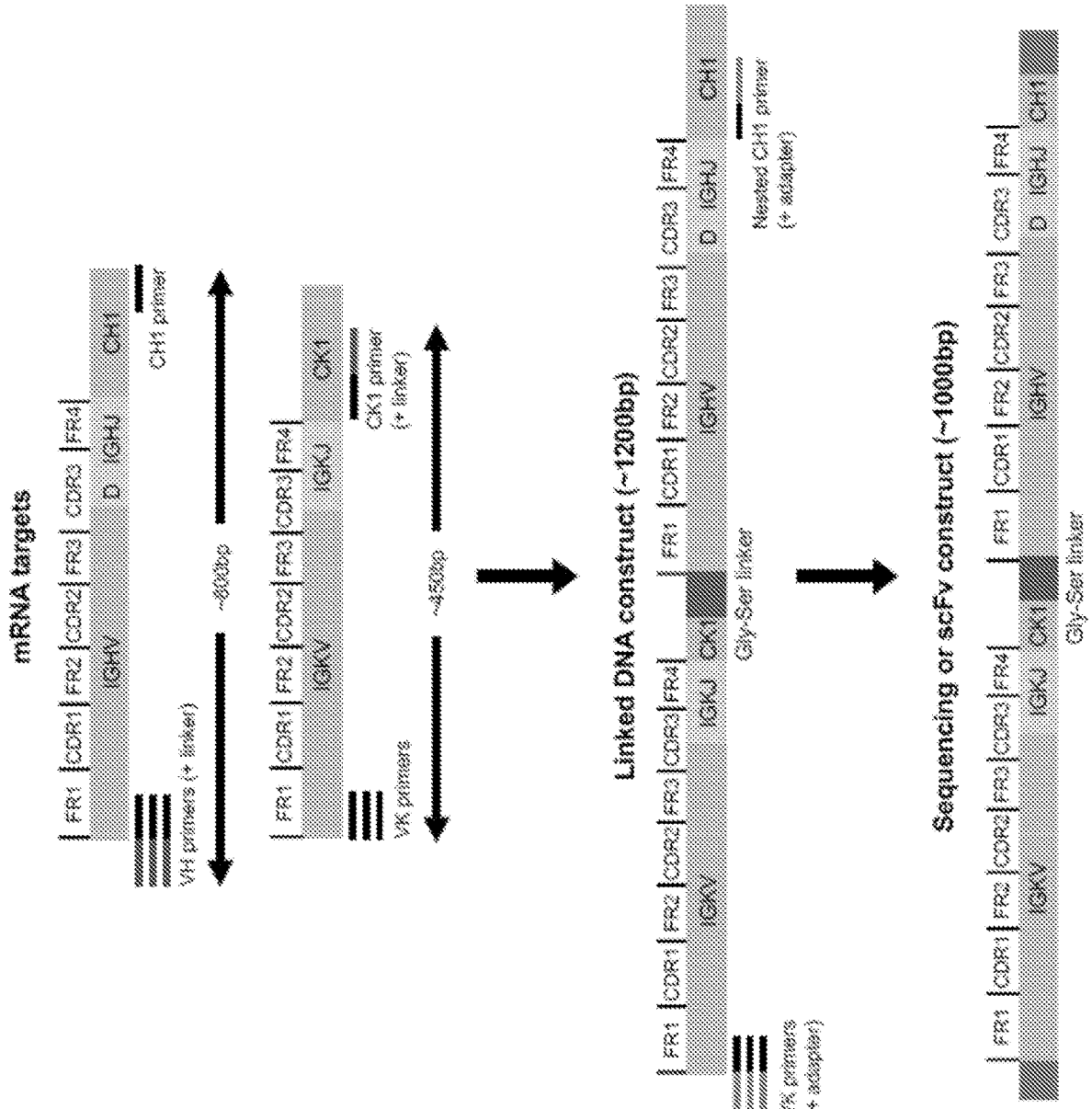

FIG. 2 illustrates scFv amplification procedure. First, a mixture of primers directed against the IgK C region, the IgG C region, and all V regions is used to separately amplify IgK and IgH. Second, the V-H and C-K primers contain a region of complementarity that results in the formation of an overlap extension amplicon that is a fusion product between IgK and IgH. The region of complementarity comprises a DNA sequence that encodes a Gly-Ser rich scFv linker sequence. Third, semi-nested PCR is performed to add adapters for Illumina sequencing or yeast display.

Figure 3:
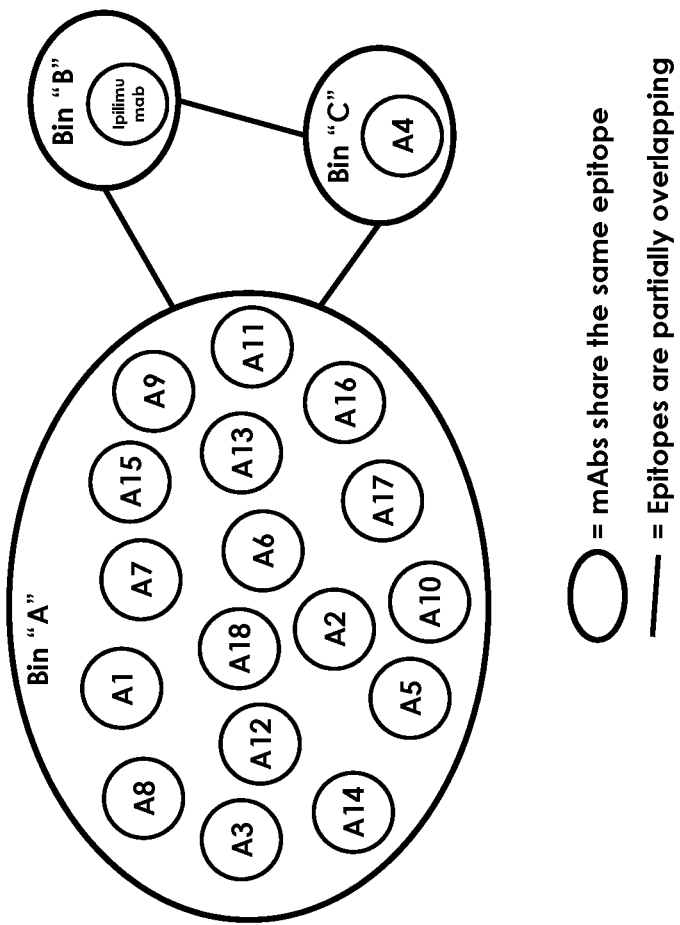

FIG. 3 includes a schematic for the monoclonal antibodies sorted in their epitope bins.

Figure 4:
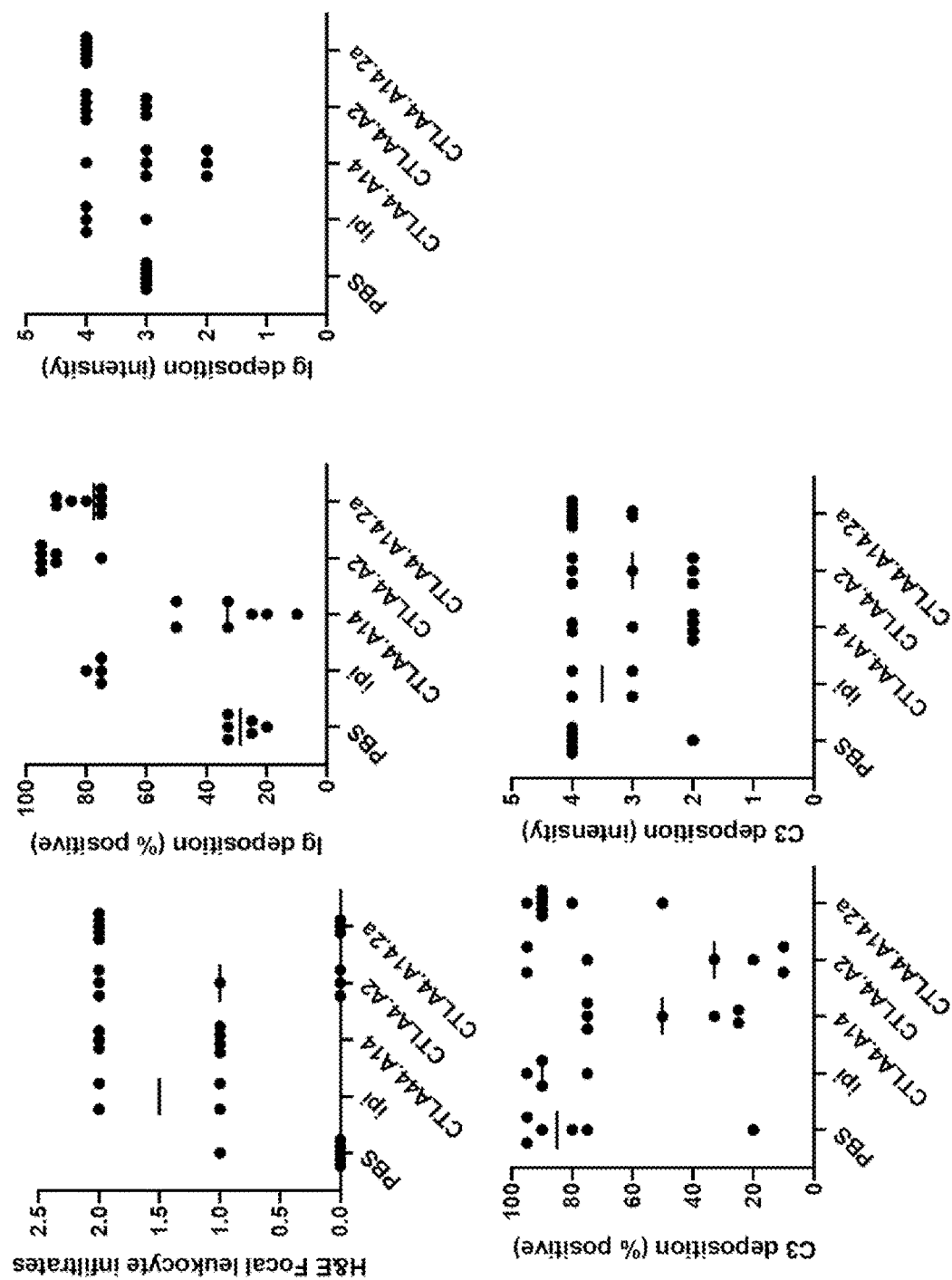

FIG. 4 includes plots from the histopathological staining of hCTLA-4 KI mice bearing MC38 tumors. The plots show scoring of H&E, immunoglobulin (Ig), and C3 stains from the right kidney. ipi is Ipilimumab, and CTLA4.A14.2a is antibody A14 cloned onto a mouse IgG2a backbone.

Figure 5:
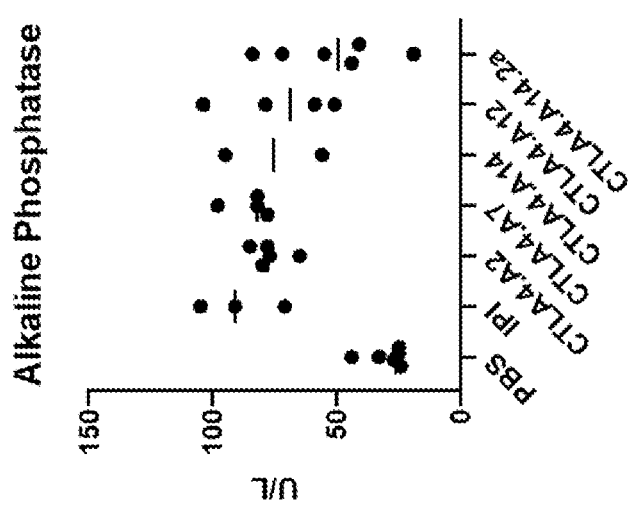

FIG. 5 includes a plot showing the alkaline phosphatase levels in treated hCTLA4 KI mice bearing MC38 tumors. IPI is Ipilimumab, and CTLA4.A14.2a is antibody A14 cloned onto a mouse IgG2a backbone. U/L is units per liter.

Figure 6:
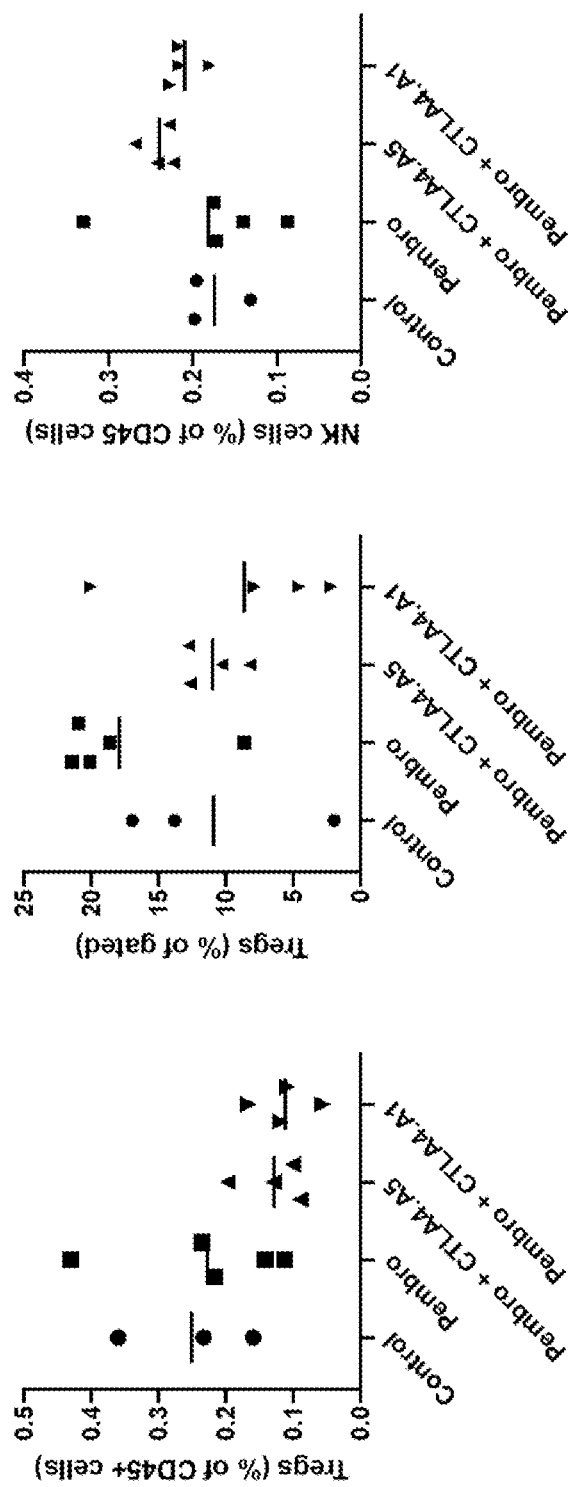

FIG. 6 includes plots for the percentages of intratumoral regulatory T cells (Treg) cells and intratumoral natural killer (NK) cells after the indicated treatments.

Figure 7:
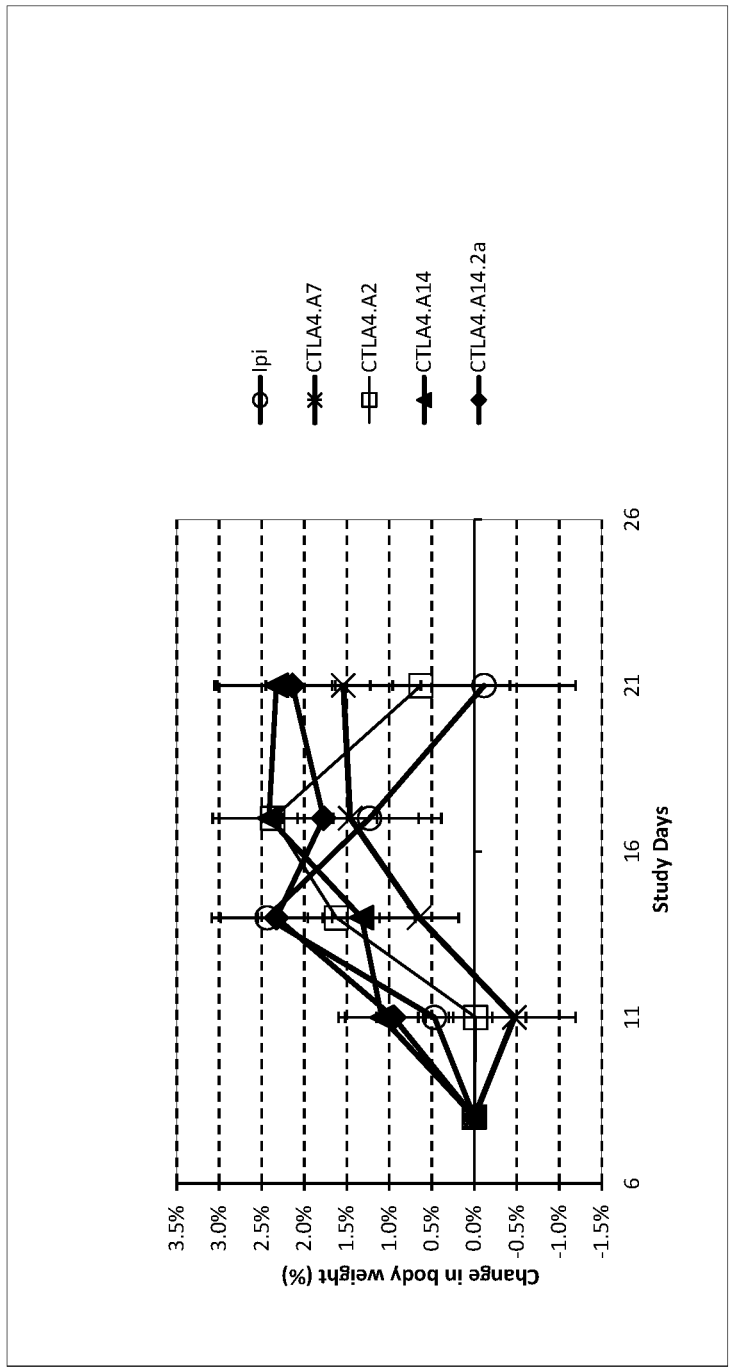

FIG. 7 includes a plot showing the changes in body weight of the hCTLA4 mice receiving the indicated treatments. Ipi is Ipilimumab, and CTLA4.A14.2a is antibody A14 cloned onto a mouse IgG2a backbone. Error bars represent+/−standard error of the mean.

Figure 8:
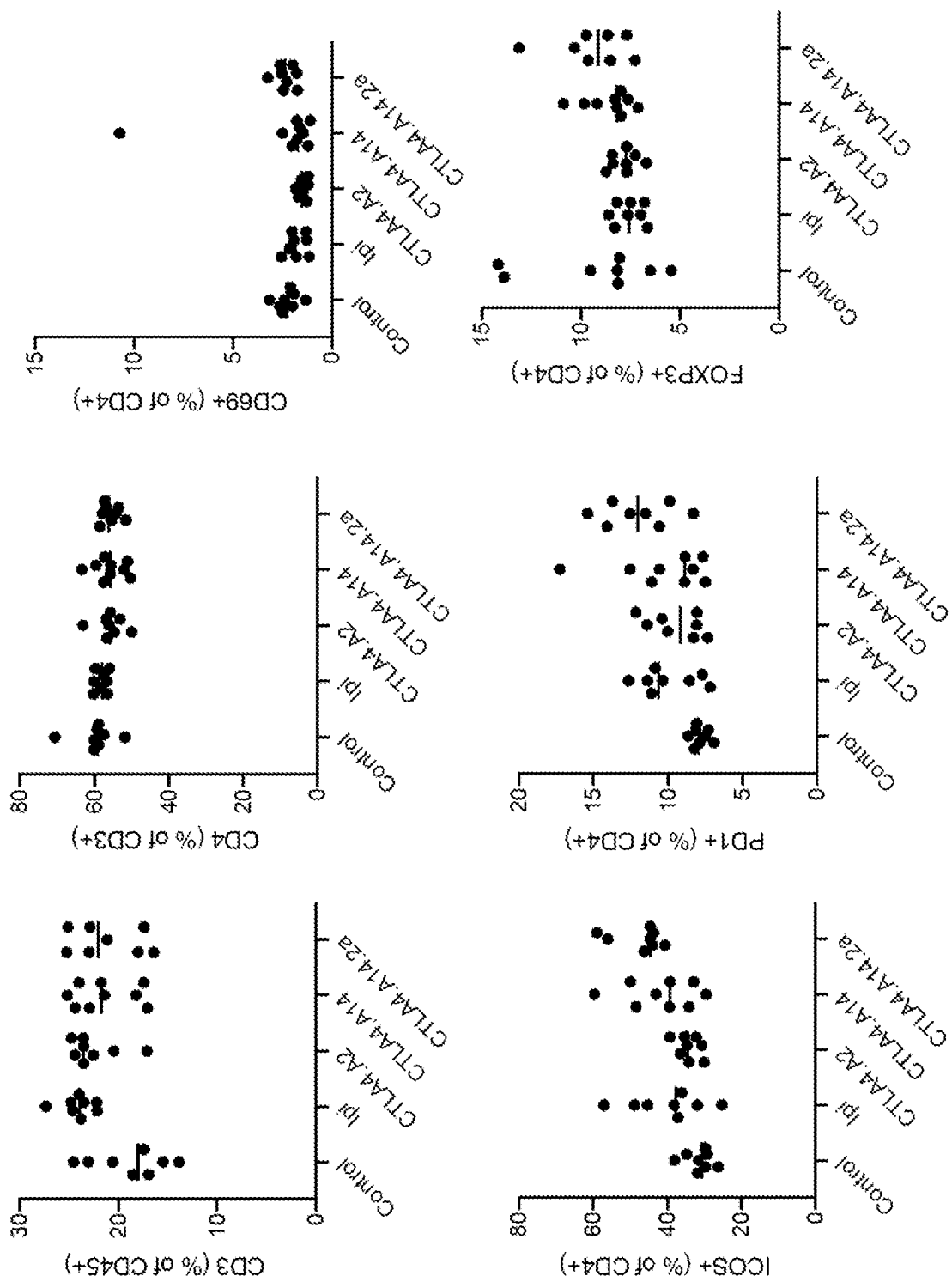

FIG. 8 includes plots showing the influence of the control, Ipi and the anti-CTLA4 treatments on percentage of the indicated cell populations. Ipi is Ipilimumab, and CTLA4.A14.2a is antibody A14 cloned onto a mouse IgG2a backbone.

Figure 9:
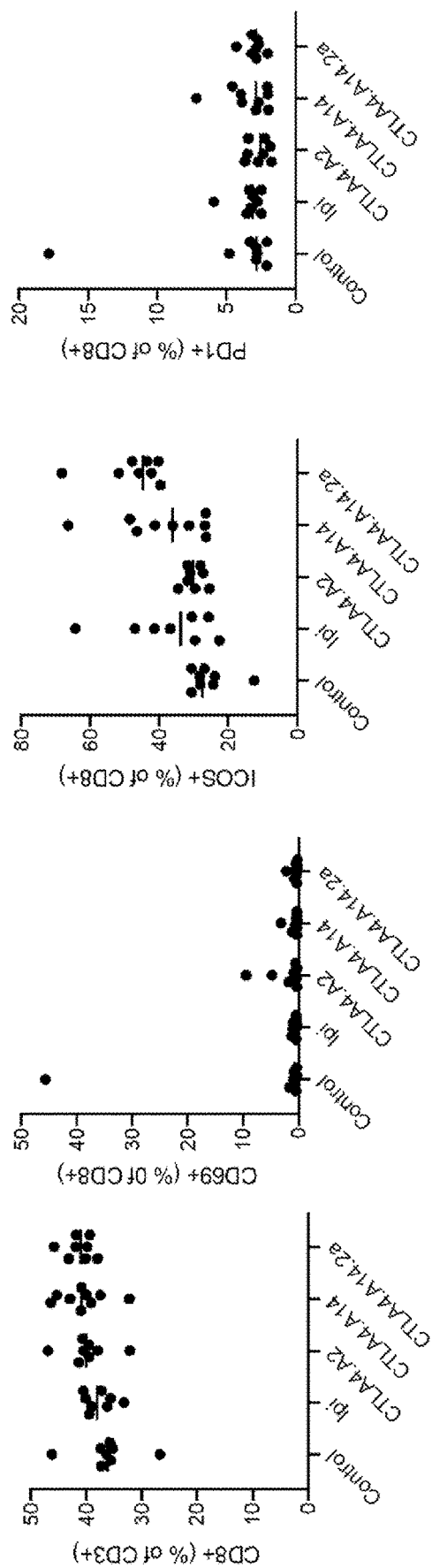

FIG. 9 includes plots showing the influence of the control, Ipi and the anti-CTLA4 treatments on percentage of the indicated cell populations. Ipi is Ipilimumab, and CTLA4.A14.2a is antibody A14 cloned onto a mouse IgG2a backbone.

Figure 10:
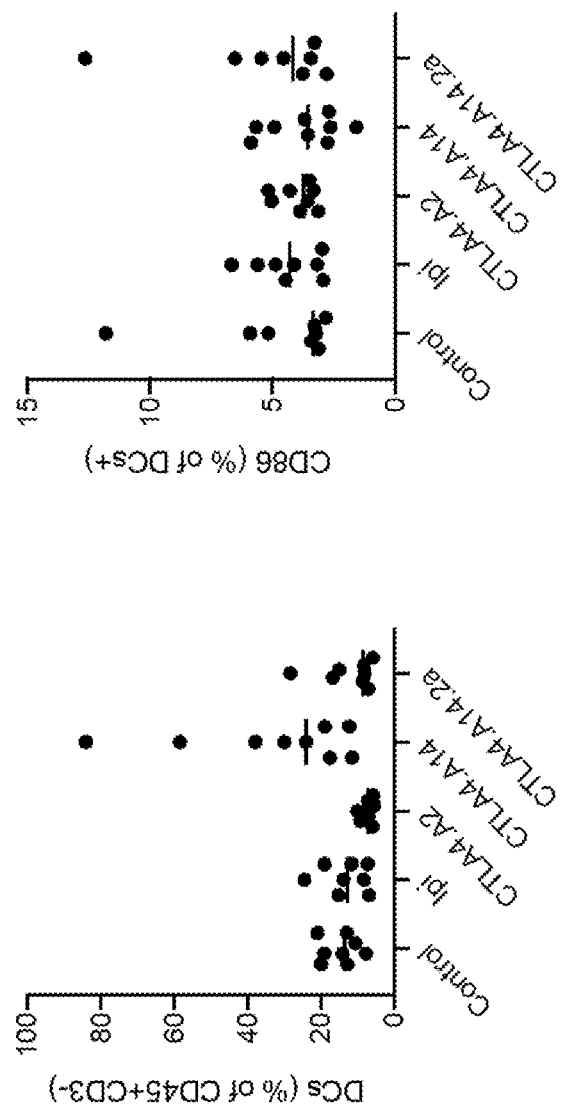

FIG. 10 includes plots showing the influence of the control, Ipi and the anti-CTLA4 treatments on percentage of dendritic cells (DCs) and activated dendritic cells (CD86+). Ipi is Ipilimumab, and CTLA4.A14.2a is antibody A14 cloned onto a mouse IgG2a backbone.

Figure 11:
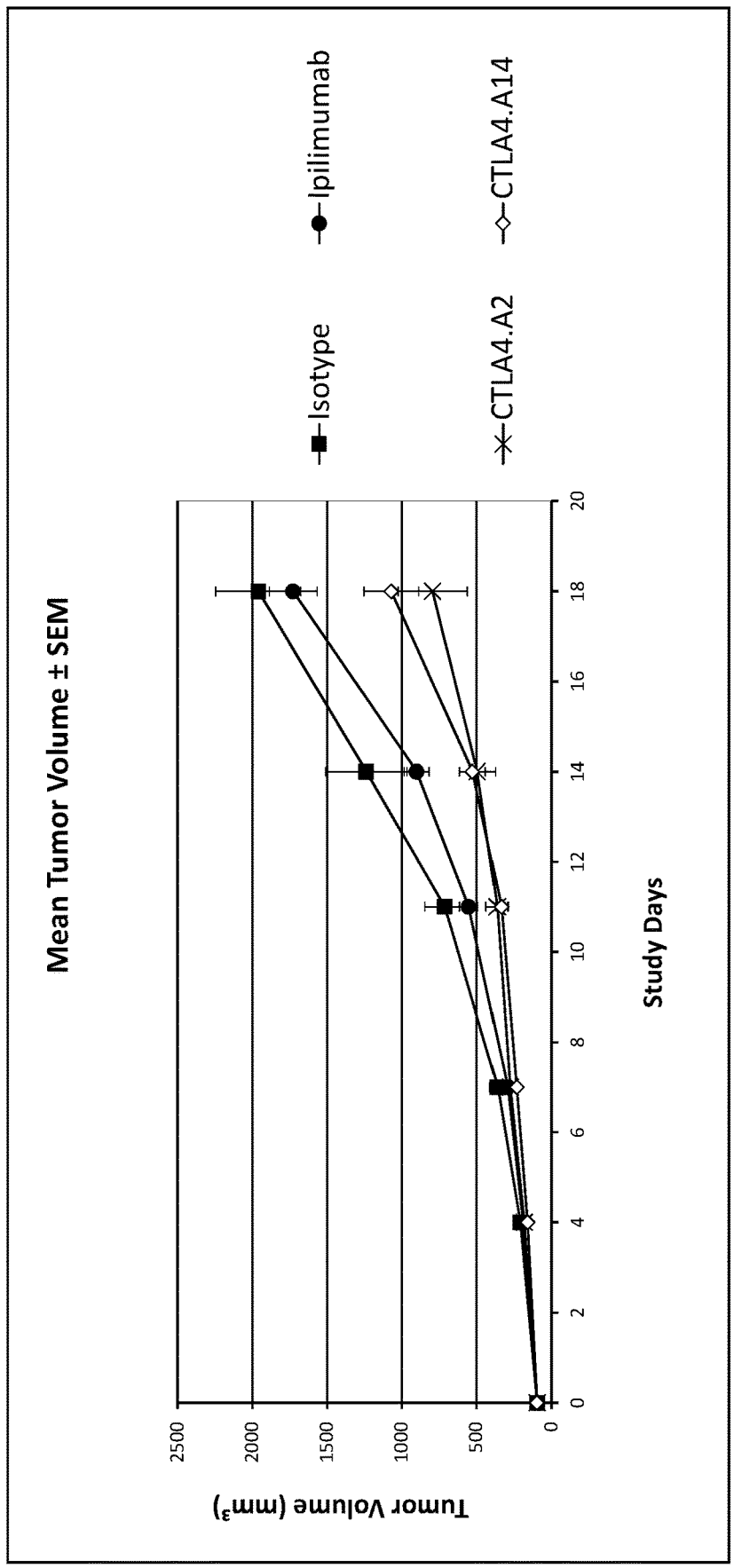

FIG. 11 includes a plot showing the mean tumor volume after treatment with 0.3 mg/kg of the indicated anti-CTLA4s.

7. DETAILED DESCRIPTION

7.1. Definitions

Unless otherwise defined herein, scientific and technical terms used in connection with the present disclosure shall have the meanings that are commonly understood by those of ordinary skill in the art. Further, unless otherwise required by context, singular terms shall include pluralities and plural terms shall include the singular. Generally, nomenclatures used in connection with, and techniques of, cell and tissue culture, molecular biology, immunology, microbiology, genetics and protein and nucleic acid chemistry and hybridization described herein are those well-known and commonly used in the art. The methods and techniques of the present disclosure are generally performed according to conventional methods well known in the art and as described in various general and more specific references that are cited and discussed throughout the present specification unless otherwise indicated. See, e.g., Sambrook et al. *Molecular Cloning: A Laboratory Manual, 2d ed.*, Cold Spring Harbor Laboratory Press, Cold Spring Harbor, N.Y. (1989) and Ausubel et al., *Current Protocols in Molecular Biology*, Greene Publishing Associates (1992), and Harlow and Lane *Antibodies: A Laboratory Manual* Cold Spring Harbor Laboratory Press, Cold Spring Harbor, N.Y. (1990), which are incorporated herein by reference. Enzymatic reactions and purification techniques are performed according to manufacturer's specifications, as commonly accomplished in the art or as described herein. The terminology used in connection with, and the laboratory procedures and techniques of, analytical chemistry, synthetic organic chemistry, and medicinal and pharmaceutical chemistry described herein are those well-known and commonly used in the art. Standard techniques can be used for chemical syntheses, chemical analyses, pharmaceutical preparation, formulation, and delivery, and treatment of patients.

The following terms, unless otherwise indicated, shall be understood to have the following meanings:

The terms "CTLA-4," "CTLA-4 protein," and "CTLA-4 antigen" are used interchangeably herein to refer to human CTLA-4, or any variants (e.g., splice variants and allelic variants), isoforms, and species homologs of human CTLA-4 that are naturally expressed by cells, or that are expressed by cells transfected with a ctla4 gene. In some aspects, the CTLA-4 protein is a (CTLA-4 protein naturally expressed by a primate (e.g., a monkey or a human), a rodent (e.g., a mouse or a rat), a dog, a camel, a cat, a cow, a goat, a horse, or a sheep. In some aspects, the CTLA-4 protein is human CTLA-4 (hCTLA-4; SEQ ID NO: 7001).

The term "immunoglobulin" refers to a class of structurally related proteins generally comprising two pairs of polypeptide chains: one pair of light (L) chains and one pair of heavy (H) chains. In an "intact immunoglobulin," all four of these chains are interconnected by disulfide bonds. The structure of immunoglobulins has been well characterized. See, e.g., Paul, *Fundamental Immunology* 7th ed., Ch. 5 (2013) Lippincott Williams & Wilkins, Philadelphia, PA. Briefly, each heavy chain typically comprises a heavy chain variable region ($V_H$) and a heavy chain constant region (CH). The heavy chain constant region typically comprises three domains, abbreviated $C_{H1}$, $C_{H2}$, and $C_{H3}$. Each light chain typically comprises a light chain variable region ($V_L$) and a light chain constant region. The light chain constant region typically comprises one domain, abbreviated $C_L$.

The term "antigen-binding protein" (ABP) refers to a protein comprising one or more antigen-binding domains that specifically bind to an antigen or epitope. In some embodiments, the antigen-binding domain binds the antigen or epitope with specificity and affinity similar to that of naturally occurring antibodies. In some embodiments, the ABP comprises an antibody. In some embodiments, the ABP consists of an antibody. In some embodiments, the ABP consists essentially of an antibody. In some embodiments, the ABP comprises an alternative scaffold. In some embodiments, the ABP consists of an alternative scaffold. In some embodiments, the ABP consists essentially of an alternative scaffold. In some embodiments, the ABP comprises an antibody fragment. In some embodiments, the ABP consists of an antibody fragment. In some embodiments, the ABP consists essentially of an antibody fragment. A "CTLA-4 ABP," "anti-CTLA-4 ABP," or "CTLA-4-specific ABP" is an ABP, as provided herein, which specifically binds to the antigen CTLA-4. In some embodiments, the ABP binds the extracellular domain of CTLA-4. In certain embodiments, a CTLA-4 ABP provided herein binds to an epitope of CTLA-4 that is conserved between or among CTLA-4 proteins from different species.

The term "antibody" is used herein in its broadest sense and includes certain types of immunoglobulin molecules comprising one or more antigen-binding domains that specifically bind to an antigen or epitope. An antibody specifically includes intact antibodies (e.g., intact immunoglobulins), antibody fragments, and multi-specific antibodies. One example of an antigen-binding domain is an antigen-binding domain formed by a $V_H$-$V_L$ dimer. An antibody is one type of ABP.

The term "alternative scaffold" refers to a molecule in which one or more regions may be diversified to produce one or more antigen-binding domains that specifically bind to an antigen or epitope. In some embodiments, the antigen-binding domain binds the antigen or epitope with specificity and affinity similar to that of naturally occurring antibodies. Exemplary alternative scaffolds include those derived from fibronectin (e.g., Adnectins™), the β-sandwich (e.g., iMab), lipocalin (e.g., Anticalins®), EETI-II/AGRP, BPTI/LACI-D1/ITI-D2 (e.g., Kunitz domains), thioredoxin peptide aptamers, protein A (e.g., Affibody®), ankyrin repeats (e.g., DARPins), gamma-B-crystallin/ubiquitin (e.g., Affilins), CTLD3 (e.g., Tetranectins), Fynomers, and (LDLR-A module) (e.g., Avimers). Additional information on alternative scaffolds is provided in Binz et al., *Nat. Biotechnol.*, 2005

23:1257-1268; Skerra, *Current Opin. in Biotech.*, 2007 18:295-304; and Silacci et al., *J. Biol. Chem.*, 2014, 289: 14392-14398; each of which is incorporated by reference in its entirety. An alternative scaffold is one type of ABP.

The term "antigen-binding domain" means the portion of an ABP that is capable of specifically binding to an antigen or epitope.

The terms "full length antibody," "intact antibody," and "whole antibody" are used herein interchangeably to refer to an antibody having a structure substantially similar to a naturally occurring antibody structure and having heavy chains that comprise an Fc region.

The term "Fc region" means the C-terminal region of an immunoglobulin heavy chain that, in naturally occurring antibodies, interacts with Fc receptors and certain proteins of the complement system. The structures of the Fc regions of various immunoglobulins, and the glycosylation sites contained therein, are known in the art. See Schroeder and Cavacini, *J. Allergy Clin. Immunol.*, 2010, 125:S41-52, incorporated by reference in its entirety. The Fc region may be a naturally occurring Fc region, or an Fc region modified as described elsewhere in this disclosure.

The $V_H$ and $V_L$ regions may be further subdivided into regions of hypervariability ("hypervariable regions (HVRs);" also called "complementarity determining regions" (CDRs)) interspersed with regions that are more conserved. The more conserved regions are called framework regions (FRs). Each $V_H$ and $V_L$ generally comprises three CDRs and four FRs, arranged in the following order (from N-terminus to C-terminus): FR1-CDR1-FR2-CDR2-FR3-CDR3-FR4. The CDRs are involved in antigen binding, and influence antigen specificity and binding affinity of the antibody. See Kabat et al., *Sequences of Proteins of Immunological Interest* 5th ed. (1991) Public Health Service, National Institutes of Health, Bethesda, MD, incorporated by reference in its entirety.

The light chain from any vertebrate species can be assigned to one of two types, called kappa (κ) and lambda (λ), based on the sequence of its constant domain.

The heavy chain from any vertebrate species can be assigned to one of five different classes (or isotypes): IgA, IgD, IgE, IgG, and IgM. These classes are also designated α, δ, ε, γ, and μ, respectively. The IgG and IgA classes are further divided into subclasses on the basis of differences in sequence and function. Humans express the following subclasses: IgG1, IgG2, IgG3, IgG4, IgA1, and IgA2.

The amino acid sequence boundaries of a CDR can be determined by one of skill in the art using any of a number of known numbering schemes, including those described by Kabat et al., *supra* ("Kabat" numbering scheme); A1-Lazikani et al., 1997, *J. Mol. Biol.*, 273:927-948 ("Chothia" numbering scheme); MacCallum et al., 1996, *J. Mol. Biol.* 262:732-745 ("Contact" numbering scheme); Lefranc et al., *Dev. Comp. Immunol.*, 2003, 27:55-77 ("IMGT" numbering scheme); and Honegge and Plückthun, *J. Mol. Biol.*, 2001, 309:657-70 ("AHo" numbering scheme); each of which is incorporated by reference in its entirety.

Table 1 provides the positions of CDR1-L (CDR1 of $V_L$), CDR2-L (CDR2 of $V_L$), CDR3-L (CDR3 of $V_L$), CDR1-H (CDR1 of $V_H$), CDR2-H (CDR2 of $V_H$), and CDR3-H (CDR3 of $V_H$), as identified by the Kabat and Chothia schemes. For CDR1-H, residue numbering is provided using both the Kabat and Chothia numbering schemes.

CDRs may be assigned, for example, using antibody numbering software, such as Abnum, available at www.bio-inf.org.uk/abs/abnum/, and described in Abhinandan and Martin, *Immunology*, 2008, 45:3832-3839, incorporated by reference in its entirety.

TABLE 1

Residues in CDRs according to Kabat and Chothia numbering schemes.

| CDR | Kabat | Chothia |
|---|---|---|
| CDR1-L | 24-34 | 24-34 |
| CDR2-L | 50-56 | 50-56 |
| CDR3-L | 89-97 | 89-97 |
| CDR1-H (Kabat Numbering) | 31-35B | 26-32 or 34* |
| CDR1-H (Chothia Numbering) | 31-35 | 26-32 |
| CDR2-H | 50-65 | 52-56 |
| CDR3-H | 95-102 | 95-102 |

*The C-terminus of CDR1-H, when numbered using the Kabat numbering convention, varies between 32 and 34, depending on the length of the CDR.

The "EU numbering scheme" is generally used when referring to a residue in an antibody heavy chain constant region (e.g., as reported in Kabat et al., *supra*).

An "antibody fragment" comprises a portion of an intact antibody, such as the antigen-binding or variable region of an intact antibody. Antibody fragments include, for example, Fv fragments, Fab fragments, F(ab')$_2$ fragments, Fab' fragments, scFv (sFv) fragments, and scFv-Fc fragments.

"Fv" fragments comprise a non-covalently-linked dimer of one heavy chain variable domain and one light chain variable domain.

"Fab" fragments comprise, in addition to the heavy and light chain variable domains, the constant domain of the light chain and the first constant domain ($C_{H1}$) of the heavy chain. Fab fragments may be generated, for example, by recombinant methods or by papain digestion of a full-length antibody.

"F(ab')$_2$" fragments contain two Fab' fragments joined, near the hinge region, by disulfide bonds. F(ab')$_2$ fragments may be generated, for example, by recombinant methods or by pepsin digestion of an intact antibody. The F(ab') fragments can be dissociated, for example, by treatment with β-mercaptoethanol.

"Single-chain Fv" or "sFv" or "scFv" antibody fragments comprise a $V_H$ domain and a $V_L$ domain in a single polypeptide chain. The $V_H$ and $V_L$ are generally linked by a peptide linker. See Plückthun A. (1994). In some embodiments, the linker is a (GGGGS)$_n$ (SEQ ID NO: 11968). In some embodiments, n=1, 2, 3, 4, 5, or 6. See Antibodies from *Escherichia coli*. In Rosenberg M. & Moore G. P. (Eds.), *The Pharmacology of Monoclonal Antibodies* vol. 113 (pp. 269-315). Springer-Verlag, New York, incorporated by reference in its entirety.

"scFv-Fc" fragments comprise an scFv attached to an Fc domain. For example, an Fc domain may be attached to the C-terminal of the scFv. The Fc domain may follow the $V_H$ or $V_L$, depending on the orientation of the variable domains in the scFv (i.e., $V_H$-$V_L$ or $V_L$-$V_H$). Any suitable Fc domain known in the art or described herein may be used. In some cases, the Fc domain comprises an IgG4 Fc domain.

The term "single domain antibody" refers to a molecule in which one variable domain of an antibody specifically binds to an antigen without the presence of the other variable domain. Single domain antibodies, and fragments thereof, are described in Arabi Ghahroudi et al., *FEBS Letters*, 1998, 414:521-526 and Muyldermans et al., *Trends in Biochem. Sci.*, 2001, 26:230-245, each of which is incorporated by reference in its entirety.

A "monospecific ABP" is an ABP that comprises a binding site that specifically binds to a single epitope. An example of a monospecific ABP is a naturally occurring IgG molecule which, while divalent, recognizes the same epitope at each antigen-binding domain. The binding specificity may be present in any suitable valency.

The term "monoclonal antibody" refers to an antibody from a population of substantially homogeneous antibodies. A population of substantially homogeneous antibodies comprises antibodies that are substantially similar and that bind the same epitope(s), except for variants that may normally arise during production of the monoclonal antibody. Such variants are generally present in only minor amounts. A monoclonal antibody is typically obtained by a process that includes the selection of a single antibody from a plurality of antibodies. For example, the selection process can be the selection of a unique clone from a plurality of clones, such as a pool of hybridoma clones, phage clones, yeast clones, bacterial clones, or other recombinant DNA clones. The selected antibody can be further altered, for example, to improve affinity for the target ("affinity maturation"), to humanize the antibody, to improve its production in cell culture, and/or to reduce its immunogenicity in a subject.

The term "chimeric antibody" refers to an antibody in which a portion of the heavy and/or light chain is derived from a particular source or species, while the remainder of the heavy and/or light chain is derived from a different source or species.

"Humanized" forms of non-human antibodies are chimeric antibodies that contain minimal sequence derived from the non-human antibody. A humanized antibody is generally a human antibody (recipient antibody) in which residues from one or more CDRs are replaced by residues from one or more CDRs of a non-human antibody (donor antibody). The donor antibody can be any suitable non-human antibody, such as a mouse, rat, rabbit, chicken, or non-human primate antibody having a desired specificity, affinity, or biological effect. In some instances, selected framework region residues of the recipient antibody are replaced by the corresponding framework region residues from the donor antibody. Humanized antibodies may also comprise residues that are not found in either the recipient antibody or the donor antibody. Such modifications may be made to further refine antibody function. For further details, see Jones et al., *Nature*, 1986, 321:522-525; Riechmann et al., *Nature*, 1988, 332:323-329; and Presta, *Curr. Op. Struct. Biol.*, 1992, 2:593-596, each of which is incorporated by reference in its entirety.

A "human antibody" is one which possesses an amino acid sequence corresponding to that of an antibody produced by a human or a human cell, or derived from a non-human source that utilizes a human antibody repertoire or human antibody-encoding sequences (e.g., obtained from human sources or designed de novo). Human antibodies specifically exclude humanized antibodies. In some embodiments, rodents are genetically engineered to replace their rodent antibody sequences with human antibodies.

An "isolated ABP" or "isolated nucleic acid" is an ABP or nucleic acid that has been separated and/or recovered from a component of its natural environment. Components of the natural environment may include enzymes, hormones, and other proteinaceous or nonproteinaceous materials. In some embodiments, an isolated ABP is purified to a degree sufficient to obtain at least 15 residues of N-terminal or internal amino acid sequence, for example by use of a spinning cup sequenator. In some embodiments, an isolated ABP is purified to homogeneity by gel electrophoresis (e.g., SDS-PAGE) under reducing or nonreducing conditions, with detection by Coomassie blue or silver stain. An isolated ABP includes an ABP in situ within recombinant cells, since at least one component of the ABP's natural environment is not present. In some aspects, an isolated ABP or isolated nucleic acid is prepared by at least one purification step. In some embodiments, an isolated ABP or isolated nucleic acid is purified to at least 80%, 85%, 90%, 95%, or 99% by weight. In some embodiments, an isolated ABP or isolated nucleic acid is purified to at least 80%, 85%, 90%, 95%, or 99% by volume. In some embodiments, an isolated ABP or isolated nucleic acid is provided as a solution comprising at least 85%, 90%, 95%, 98%, 99% to 100% ABP or nucleic acid by weight. In some embodiments, an isolated ABP or isolated nucleic acid is provided as a solution comprising at least 85%, 90%, 95%, 98%, 99% to 100% ABP or nucleic acid by volume.

"Affinity" refers to the strength of the sum total of non-covalent interactions between a single binding site of a molecule (e.g., an ABP) and its binding partner (e.g., an antigen or epitope). Unless indicated otherwise, as used herein, "affinity" refers to intrinsic binding affinity, which reflects a 1:1 interaction between members of a binding pair (e.g., ABP and antigen or epitope). The affinity of a molecule X for its partner Y can be represented by the dissociation equilibrium constant ($K_D$). The kinetic components that contribute to the dissociation equilibrium constant are described in more detail below. Affinity can be measured by common methods known in the art, including those described herein. Affinity can be determined, for example, using surface plasmon resonance (SPR) technology (e.g., BIACORE®) or biolayer interferometry (e.g., FORTEBIO®).

With regard to the binding of an ABP to a target molecule, the terms "bind," "specific binding," "specifically binds to," "specific for," "selectively binds," and "selective for" a particular antigen (e.g., a polypeptide target) or an epitope on a particular antigen mean binding that is measurably different from a non-specific or non-selective interaction (e.g., with a non-target molecule). Specific binding can be measured, for example, by measuring binding to a target molecule and comparing it to binding to a non-target molecule. Specific binding can also be determined by competition with a control molecule that mimics the epitope recognized on the target molecule. In that case, specific binding is indicated if the binding of the ABP to the target molecule is competitively inhibited by the control molecule. In some aspects, the affinity of a CTLA-4 ABP for a non-target molecule is less than about 50% of the affinity for CTLA-4. In some aspects, the affinity of a CTLA-4 ABP for a non-target molecule is less than about 40% of the affinity for CTLA-4. In some aspects, the affinity of a CTLA-4 ABP for a non-target molecule is less than about 30% of the affinity for CTLA-4. In some aspects, the affinity of a CTLA-4 ABP for a non-target molecule is less than about 20% of the affinity for CTLA-4. In some aspects, the affinity of a CTLA-4 ABP for a non-target molecule is less than about 10% of the affinity for CTLA-4. In some aspects, the affinity of a CTLA-4 ABP for a non-target molecule is less than about 1% of the affinity for CTLA-4. In some aspects, the affinity of a CTLA-4 ABP for a non-target molecule is less than about 0.1% of the affinity for CTLA-4.

The term "$k_d$" (sec$^{-1}$), as used herein, refers to the dissociation rate constant of a particular ABP-antigen interaction. This value is also referred to as the $k_{off}$ value.

The term "$k_a$" ($M^{-1} \times sec^{-1}$), as used herein, refers to the association rate constant of a particular ABP-antigen interaction. This value is also referred to as the $k_{on}$ value.

The term "$K_D$" (M), as used herein, refers to the dissociation equilibrium constant of a particular ABP-antigen interaction. $K_D = k_d/k_a$.

The term "$K_A$" ($M^{-1}$), as used herein, refers to the association equilibrium constant of a particular ABP-antigen interaction. $K_A = k_a/k_d$.

An "affinity matured" ABP is one with one or more alterations (e.g., in one or more CDRs or FRs) that result in an improvement in the affinity of the ABP for its antigen, compared to a parent ABP which does not possess the alteration(s). In one embodiment, an affinity matured ABP has nanomolar or picomolar affinity for the target antigen. Affinity matured ABPs may be produced using a variety of methods known in the art. For example, Marks et al. (*Bio/Technology*, 1992, 10:779-783, incorporated by reference in its entirety) describes affinity maturation by $V_H$ and $V_L$ domain shuffling. Random mutagenesis of CDR and/or framework residues is described by, for example, Barbas et al. (*Proc. Nat. Acad. Sci.* U.S.A., 1994, 91:3809-3813); Schier et al., *Gene*, 1995, 169:147-155; Yelton et al., *J. Immunol.*, 1995, 155:1994-2004; Jackson et al., *J. Immunol.*, 1995, 154:3310-33199; and Hawkins et al, *J. Mol. Biol.*, 1992, 226:889-896; each of which is incorporated by reference in its entirety.

An "immunoconjugate" is an ABP conjugated to one or more heterologous molecule(s).

"Effector functions" refer to those biological activities mediated by the Fc region of an antibody, which activities may vary depending on the antibody isotype. Examples of antibody effector functions include C1q binding to activate complement dependent cytotoxicity (CDC), Fc receptor binding to activate antibody-dependent cellular cytotoxicity (ADCC), and antibody dependent cellular phagocytosis (ADCP).

When used herein in the context of two or more ABPs, the term "competes with" or "cross-competes with" indicates that the two or more ABPs compete for binding to an antigen (e.g., CTLA-4). In one exemplary assay, CTLA-4 is coated on a surface and contacted with a first CTLA-4 ABP, after which a second CTLA-4 ABP is added. In another exemplary assay, a first CTLA-4 ABP is coated on a surface and contacted with CTLA-4, and then a second CTLA-4 ABP is added. If the presence of the first CTLA-4 ABP reduces binding of the second CTLA-4 ABP, in either assay, then the ABPs compete. The term "competes with" also includes combinations of ABPs where one ABP reduces binding of another ABP, but where no competition is observed when the ABPs are added in the reverse order. However, in some embodiments, the first and second ABPs inhibit binding of each other, regardless of the order in which they are added. In some embodiments, one ABP reduces binding of another ABP to its antigen by at least 25%, at least 50%, at least 60%, at least 70%, at least 80%, at least 85%, at least 90%, or at least 95%. A skilled artisan can select the concentrations of the antibodies used in the competition assays based on the affinities of the ABPs for CTLA-4 and the valency of the ABPs. The assays described in this definition are illustrative, and a skilled artisan can utilize any suitable assay to determine if antibodies compete with each other. Suitable assays are described, for example, in Cox et al., "Immunoassay Methods," in Assay Guidance Manual[Internet], Updated Dec. 24, 2014 (www.ncbi.nlm.nih.gov/books/NBK92434/; accessed Sep. 29, 2015); Silman et al., *Cytometry*, 2001, 44:30-37; and Finco et al., *J. Pharm. Biomed. Anal.*, 2011, 54:351-358; each of which is incorporated by reference in its entirety.

The term "epitope" means a portion of an antigen the specifically binds to an ABP. Epitopes frequently consist of surface-accessible amino acid residues and/or sugar side chains and may have specific three dimensional structural characteristics, as well as specific charge characteristics. Conformational and non-conformational epitopes are distinguished in that the binding to the former but not the latter may be lost in the presence of denaturing solvents. An epitope may comprise amino acid residues that are directly involved in the binding, and other amino acid residues, which are not directly involved in the binding. The epitope to which an ABP binds can be determined using known techniques for epitope determination such as, for example, testing for ABP binding to CTLA-4 variants with different point-mutations, or to chimeric CTLA-4 variants.

Percent "identity" between a polypeptide sequence and a reference sequence, is defined as the percentage of amino acid residues in the polypeptide sequence that are identical to the amino acid residues in the reference sequence, after aligning the sequences and introducing gaps, if necessary, to achieve the maximum percent sequence identity. Alignment for purposes of determining percent amino acid sequence identity can be achieved in various ways that are within the skill in the art, for instance, using publicly available computer software such as BLAST, BLAST-2, ALIGN, MEGALIGN (DNASTAR), CLUSTALW, CLUSTAL OMEGA, or MUSCLE software. Those skilled in the art can determine appropriate parameters for aligning sequences, including any algorithms needed to achieve maximal alignment over the full length of the sequences being compared.

A "conservative substitution" or a "conservative amino acid substitution," refers to the substitution an amino acid with a chemically or functionally similar amino acid. Conservative substitution tables providing similar amino acids are well known in the art. By way of example, the groups of amino acids provided in TABLES 2-4 are, in some embodiments, considered conservative substitutions for one another.

TABLE 2

Selected groups of amino acids that are considered conservative substitutions for one another, in certain embodiments.

| | |
|---|---|
| Acidic Residues | D and E |
| Basic Residues | K, R, and H |
| Hydrophilic Uncharged Residues | S, T, N, and Q |
| Aliphatic Uncharged Residues | G, A, V, L, and I |
| Non-polar Uncharged Residues | C, M, and P |
| Aromatic Residues | F, Y, and W |

TABLE 3

Additional selected groups of amino acids that are considered conservative substitutions for one another, in certain embodiments.

| | |
|---|---|
| Group 1 | A, S, and T |
| Group 2 | D and E |
| Group 3 | N and Q |
| Group 4 | R and K |
| Group 5 | I, L, and M |
| Group 6 | F, Y, and W |

TABLE 4

Further selected groups of amino acids that are considered conservative substitutions for one another, in certain embodiments.

| | |
|---|---|
| Group A | A and G |
| Group B | D and E |
| Group C | N and Q |
| Group D | R, K, and H |
| Group E | I, L, M, V |
| Group F | F, Y, and W |
| Group G | S and T |
| Group H | C and M |

Additional conservative substitutions may be found, for example, in Creighton, *Proteins Structures and Molecular Properties* 2nd ed. (1993) W. H. Freeman & Co., New York, NY. An ABP generated by making one or more conservative substitutions of amino acid residues in a parent ABP is referred to as a "conservatively modified variant."

The term "treating" (and variations thereof such as "treat" or "treatment") refers to clinical intervention in an attempt to alter the natural course of a disease or condition in a subject in need thereof. Treatment can be performed both for prophylaxis and during the course of clinical pathology. Desirable effects of treatment include preventing occurrence or recurrence of disease, alleviation of symptoms, diminish of any direct or indirect pathological consequences of the disease, preventing metastasis, decreasing the rate of disease progression, amelioration or palliation of the disease state, and remission or improved prognosis.

As used herein, the term "therapeutically effective amount" or "effective amount" refers to an amount of an ABP or pharmaceutical composition provided herein that, when administered to a subject, is effective to treat a disease or disorder.

As used herein, the term "subject" means a mammalian subject. Exemplary subjects include humans, monkeys, dogs, cats, mice, rats, cows, horses, camels, goats, rabbits, and sheep. In certain embodiments, the subject is a human. In some embodiments the subject has a disease or condition that can be treated with an ABP provided herein. In some aspects, the disease or condition is a cancer. In some aspects, the disease or condition is a viral infection.

The term "package insert" is used to refer to instructions customarily included in commercial packages of therapeutic or diagnostic products (e.g., kits) that contain information about the indications, usage, dosage, administration, combination therapy, contraindications and/or warnings concerning the use of such therapeutic or diagnostic products.

The term "cytotoxic agent," as used herein, refers to a substance that inhibits or prevents a cellular function and/or causes cell death or destruction.

A "chemotherapeutic agent" refers to a chemical compound useful in the treatment of cancer. Chemotherapeutic agents include "anti-hormonal agents" or "endocrine therapeutics" which act to regulate, reduce, block, or inhibit the effects of hormones that can promote the growth of cancer.

The term "cytostatic agent" refers to a compound or composition which arrests growth of a cell either in vitro or in vivo. In some embodiments, a cytostatic agent is an agent that reduces the percentage of cells in S phase. In some embodiments, a cytostatic agent reduces the percentage of cells in S phase by at least about 20%, at least about 40%, at least about 60%, or at least about 80%.

The term "tumor" refers to all neoplastic cell growth and proliferation, whether malignant or benign, and all pre-cancerous and cancerous cells and tissues. The terms "cancer," "cancerous," "cell proliferative disorder," "proliferative disorder" and "tumor" are not mutually exclusive as referred to herein. The terms "cell proliferative disorder" and "proliferative disorder" refer to disorders that are associated with some degree of abnormal cell proliferation. In some embodiments, the cell proliferative disorder is a cancer.

The term "pharmaceutical composition" refers to a preparation which is in such form as to permit the biological activity of an active ingredient contained therein to be effective in treating a subject, and which contains no additional components which are unacceptably toxic to the subject.

The terms "modulate" and "modulation" refer to reducing or inhibiting or, alternatively, activating or increasing, a recited variable.

The terms "increase" and "activate" refer to an increase of 10%, 20%, 30%, 40%, 50%, 60%, 70%, 75%, 80%, 85%, 90%, 95%, 100%, 2-fold, 3-fold, 4-fold, 5-fold, 10-fold, 20-fold, 50-fold, 100-fold, or greater in a recited variable.

The terms "reduce" and "inhibit" refer to a decrease of 10%, 20%, 30%, 40%, 50%, 60%, 70%, 75%, 80%, 85%, 90%, 95%, 2-fold, 3-fold, 4-fold, 5-fold, 10-fold, 20-fold, 50-fold, 100-fold, or greater in a recited variable.

The term "agonize" refers to the activation of receptor signaling to induce a biological response associated with activation of the receptor. An "agonist" is an entity that binds to and agonizes a receptor.

The term "antagonize" refers to the inhibition of receptor signaling to inhibit a biological response associated with activation of the receptor. An "antagonist" is an entity that binds to and antagonizes a receptor.

The term "effector T cell" includes T helper (i.e., CD4+) cells and cytotoxic (i.e., CD8+) T cells. CD4+ effector T cells contribute to the development of several immunologic processes, including maturation of B cells into plasma cells and memory B cells, and activation of cytotoxic T cells and macrophages. CD8+ effector T cells destroy virus-infected cells and tumor cells. See Seder and Ahmed, *Nature Immunol.*, 2003, 4:835-842, incorporated by reference in its entirety, for additional information on effector T cells.

The term "regulatory T cell" includes cells that regulate immunological tolerance, for example, by suppressing effector T cells. In some aspects, the regulatory T cell has a CD4+CD25+ Foxp3+ phenotype. In some aspects, the regulatory T cell has a CD8+CD25+ phenotype. See Nocentini et al., *Br. J. Pharmacol.*, 2012, 165:2089-2099, incorporated by reference in its entirety, for additional information on regulatory T cells.

The term "dendritic cell" refers to a professional antigen-presenting cell capable of activating a naïve T cell and stimulating growth and differentiation of a B cell.

A "variant" of a polypeptide (e.g., an antibody) comprises an amino acid sequence wherein one or more amino acid residues are inserted into, deleted from and/or substituted into the amino acid sequence relative to the native polypeptide sequence, and retains essentially the same biological activity as the native polypeptide. The biological activity of the polypeptide can be measured using standard techniques in the art (for example, if the variant is an antibody, its activity may be tested by binding assays, as described herein). Variants of the present disclosure include fragments, analogs, recombinant polypeptides, synthetic polypeptides, and/or fusion proteins.

A "derivative" of a polypeptide is a polypeptide (e.g., an antibody) that has been chemically modified, e.g., via conjugation to another chemical moiety such as, for example, polyethylene glycol, albumin (e.g., human serum albumin), phosphorylation, and glycosylation. Unless otherwise indicated, the term "antibody" includes, in addition to antibodies comprising two full-length heavy chains and two full-length light chains, derivatives, variants, fragments, and muteins thereof, examples of which are described below.

A nucleotide sequence is "operably linked" to a regulatory sequence if the regulatory sequence affects the expression (e.g., the level, timing, or location of expression) of the nucleotide sequence. A "regulatory sequence" is a nucleic acid that affects the expression (e.g., the level, timing, or location of expression) of a nucleic acid to which it is operably linked. The regulatory sequence can, for example, exert its effects directly on the regulated nucleic acid, or through the action of one or more other molecules (e.g., polypeptides that bind to the regulatory sequence and/or the nucleic acid). Examples of regulatory sequences include promoters, enhancers and other expression control elements (e.g., polyadenylation signals). Further examples of regulatory sequences are described in, for example, Goeddel, 1990, Gene Expression Technology: Methods in Enzymology 185, Academic Press, San Diego, CA and Baron et al., 1995, Nucleic Acids Res. 23:3605-06. [0078]

A "host cell" is a cell that can be used to express a nucleic acid, e.g., a nucleic acid of the present disclosure. A host cell can be a prokaryote, for example, E. coli, or it can be a eukaryote, for example, a single-celled eukaryote (e.g., a yeast or other fungus), a plant cell (e.g., a tobacco or tomato plant cell), an animal cell (e.g., a human cell, a monkey cell, a hamster cell, a rat cell, a mouse cell, or an insect cell) or a hybridoma. Examples of host cells include CS-9 cells, the COS-7 line of monkey kidney cells (ATCC CRL 1651) (see Gluzman et al., 1981, Cell 23:175), L cells, C127 cells, 3T3 cells (ATCC CCL 163), Chinese hamster ovary (CHO) cells or their derivatives such as Veggie CHO and related cell lines which grow in serum-free media (see Rasmussen et al., 1998, Cytotechnology 28:31), HeLa cells, BHK (ATCC CRL 10) cell lines, the CV1/EBNA cell line derived from the African green monkey kidney cell line CV1 (ATCC CCL 70) (see McMahan et al., 1991, EMBO J. 10:2821), human embryonic kidney cells such as 293, 293 EBNA or MSR 293, human epidermal A431 cells, human Colo205 cells, other transformed primate cell lines, normal diploid cells, cell strains derived from in vitro culture of primary tissue, primary explants, HL-60, U937, HaK or Jurkat cells. Typically, a host cell is a cultured cell that can be transformed or transfected with a polypeptide-encoding nucleic acid, which can then be expressed in the host cell.

The phrase "recombinant host cell" can be used to denote a host cell that has been transformed or transfected with a nucleic acid to be expressed. A host cell also can be a cell that comprises the nucleic acid but does not express it at a desired level unless a regulatory sequence is introduced into the host cell such that it becomes operably linked with the nucleic acid. It is understood that the term host cell refers not only to the particular subject cell but to the progeny or potential progeny of such a cell. Because certain modifications may occur in succeeding generations due to, e.g., mutation or environmental influence, such progeny may not, in fact, be identical to the parent cell, but are still included within the scope of the term as used herein.

7.2. Other Interpretational Conventions

Ranges recited herein are understood to be shorthand for all of the values within the range, inclusive of the recited endpoints. For example, a range of 1 to 50 is understood to include any number, combination of numbers, or sub-range from the group consisting of 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, and 50.

Unless otherwise indicated, reference to a compound that has one or more stereocenters intends each stereoisomer, and all combinations of stereoisomers, thereof.

7.3. Nucleic Acids

In one aspect, the present disclosure provides isolated nucleic acid molecules. The nucleic acids comprise, for example, polynucleotides that encode all or part of an antigen binding protein, for example, one or both chains of an antibody of the present disclosure, or a fragment, derivative, mutein, or variant thereof, polynucleotides sufficient for use as hybridization probes, PCR primers or sequencing primers for identifying, analyzing, mutating or amplifying a polynucleotide encoding a polypeptide, anti-sense nucleic acids for inhibiting expression of a polynucleotide, and complementary sequences of the foregoing. The nucleic acids can be any length. They can be, for example, 5, 10, 15, 20, 25, 30, 35, 40, 45, 50, 75, 100, 125, 150, 175, 200, 250, 300, 350, 400, 450, 500, 750, 1,000, 1,500, 3,000, 5,000 or more nucleotides in length, and/or can comprise one or more additional sequences, for example, regulatory sequences, and/or be part of a larger nucleic acid, for example, a vector. The nucleic acids can be single-stranded or double-stranded and can comprise RNA and/or DNA nucleotides, and artificial variants thereof (e.g., peptide nucleic acids).

Nucleic acids encoding antibody polypeptides (e.g., heavy or light chain, variable domain only, or full length) can be isolated from B-cells of mice that have been immunized with CTLA-4. The nucleic acid can be isolated by conventional procedures such as polymerase chain reaction (PCR).

Nucleic acid sequences encoding the variable regions of the heavy and light chain variable regions are shown herein. The skilled artisan will appreciate that, due to the degeneracy of the genetic code, each of the polypeptide sequences disclosed herein is encoded by a large number of other nucleic acid sequences. The present disclosure provides each degenerate nucleotide sequence encoding each antigen binding protein of the present disclosure.

The present disclosure further provides nucleic acids that hybridize to other nucleic acids (e.g., nucleic acids comprising a nucleotide sequence of any of CTLA-4 gene) under particular hybridization conditions. Methods for hybridizing nucleic acids are well-known in the art. See, e.g., Curr. Prot. in Mol. Biol., John Wiley & Sons, N.Y. (1989), 6.3.1-6.3.6. As defined herein, a moderately stringent hybridization condition uses a prewashing solution containing 5× sodium chloride/sodium citrate (SSC), 0.5% SDS, 1.0 mM EDTA (pH 8.0), hybridization buffer of about 50% formamide, 6×SSC, and a hybridization temperature of 55° C. (or other similar hybridization solutions, such as one containing about 50% formamide, with a hybridization temperature of 42° C.), and washing conditions of 60° C., in 0.5×SSC, 0.1% SDS. A stringent hybridization condition hybridizes in 6×SSC at 450 C, followed by one or more washes in 0.1×SSC, 0.2% SDS at 68° C. Furthermore, one of skill in the art can manipulate the hybridization and/or washing conditions to increase or decrease the stringency of hybridization such that nucleic acids comprising nucleotide sequences that are at least 65, 70, 75, 80, 85, 90, 95, 98, or 99% identical to each other typically remain hybridized to each other. The basic parameters affecting the choice of hybridization conditions and guidance for devising suitable conditions are set forth by, for example, Sambrook, Fritsch, and Maniatis (1989, Molecular Cloning: A Laboratory Manual, Cold Spring Harbor Laboratory Press, Cold Spring Harbor, N.Y., chapters 9 and 11; and Curr. Prot. in Mol. Biol. 1995, Ausubel et al., eds., John Wiley & Sons, Inc., sections 2.10 and 6.3-6.4), and can be readily determined by those having ordinary skill in the art based on, for example, the length and/or base composition of the DNA.

Changes can be introduced by mutation into a nucleic acid, thereby leading to changes in the amino acid sequence of a polypeptide (e.g., an antigen binding protein) that it encodes. Mutations can be introduced using any technique known in the art. In one embodiment, one or more particular amino acid residues are changed using, for example, a site-directed mutagenesis protocol. In another embodiment, one or more randomly selected residues are changed using, for example, a random mutagenesis protocol. However it is made, a mutant polypeptide can be expressed and screened for a desired property (e.g., binding to (CTLA-4).

Mutations can be introduced into a nucleic acid without significantly altering the biological activity of a polypeptide that it encodes. For example, one can make nucleotide substitutions leading to amino acid substitutions at non-essential amino acid residues. In one embodiment, a nucleotide sequence provided herein for CTLA-4, or a desired fragment, variant, or derivative thereof, is mutated such that it encodes an amino acid sequence comprising one or more deletions or substitutions of amino acid residues that are shown herein for CTLA-4 to be residues where two or more sequences differ. Alternatively, one or more mutations can be introduced into a nucleic acid that selectively change the biological activity (e.g., binding of CTLA-4) of a polypeptide that it encodes. For example, the mutation can quantitatively or qualitatively change the biological activity. Examples of quantitative changes include increasing, reducing or eliminating the activity. Examples of qualitative changes include changing the antigen specificity of an antigen binding protein.

In another aspect, the present disclosure provides nucleic acid molecules that are suitable for use as primers or hybridization probes for the detection of nucleic acid sequences of the present disclosure. A nucleic acid molecule of the present disclosure can comprise only a portion of a nucleic acid sequence encoding a full-length polypeptide of the present disclosure, for example, a fragment that can be used as a probe or primer or a fragment encoding an active portion (e.g., a CTLA-4 binding portion) of a polypeptide of the present disclosure.

Probes based on the sequence of a nucleic acid of the present disclosure can be used to detect the nucleic acid or similar nucleic acids, for example, transcripts encoding a polypeptide of the present disclosure. The probe can comprise a label group, e.g., a radioisotope, a fluorescent compound, an enzyme, or an enzyme co-factor. Such probes can be used to identify a cell that expresses the polypeptide

7.4. Expression Vectors

The present disclosure provides vectors comprising a nucleic acid encoding a polypeptide of the present disclosure or a portion thereof. Examples of vectors include, but are not limited to, plasmids, viral vectors, non-episomal mammalian vectors and expression vectors, for example, recombinant expression vectors.

In another aspect of the present disclosure, expression vectors containing the nucleic acid molecules and polynucleotides of the present disclosure are also provided, and host cells transformed with such vectors, and methods of producing the polypeptides are also provided. The term "expression vector" refers to a plasmid, phage, virus or vector for expressing a polypeptide from a polynucleotide sequence. Vectors for the expression of the polypeptides contain at a minimum sequences required for vector propagation and for expression of the cloned insert. An expression vector comprises a transcriptional unit comprising an assembly of (1) a genetic element or elements having a regulatory role in gene expression, for example, promoters or enhancers, (2) a sequence that encodes polypeptides and proteins to be transcribed into mRNA and translated into protein, and (3) appropriate transcription initiation and termination sequences. These sequences may further include a selection marker. Vectors suitable for expression in host cells are readily available and the nucleic acid molecules are inserted into the vectors using standard recombinant DNA techniques. Such vectors can include promoters which function in specific tissues, and viral vectors for the expression of polypeptides in targeted human or animal cells.

The recombinant expression vectors of the present disclosure can comprise a nucleic acid of the present disclosure in a form suitable for expression of the nucleic acid in a host cell. The recombinant expression vectors include one or more regulatory sequences, selected on the basis of the host cells to be used for expression, which is operably linked to the nucleic acid sequence to be expressed. Regulatory sequences include those that direct constitutive expression of a nucleotide sequence in many types of host cells (e.g., SV40 early gene enhancer, Rous sarcoma virus promoter and cytomegalovirus promoter), those that direct expression of the nucleotide sequence only in certain host cells (e.g., tissue-specific regulatory sequences, see Voss et al., 1986, Trends Biochem. Sci. 11:287, Maniatis et al., 1987, Science 236:1237, incorporated by reference herein in their entireties), and those that direct inducible expression of a nucleotide sequence in response to particular treatment or condition (e.g., the metallothionin promoter in mammalian cells and the tet-responsive and/or streptomycin responsive promoter in both prokaryotic and eukaryotic systems (see id.). It will be appreciated by those skilled in the art that the design of the expression vector can depend on such factors as the choice of the host cell to be transformed, the level of expression of protein desired, etc. The expression vectors of the present disclosure can be introduced into host cells to thereby produce proteins or peptides, including fusion proteins or peptides, encoded by nucleic acids as described herein.

In some embodiments, the expression vector is an expression vector purified from one of the clones of the library of CTLA-4 binding clones deposited under ATCC Accession No. PTA-125512. In some embodiments, the expression vector is generated by genetic modification of one of an expression vector in one of the clones purified from the library of CTLA-4 binding clones deposited under ATCC Accession No. PTA-125512. In some embodiments, the expression vector is generated by using variable region sequences of heavy and light chains of one of the clones of the library of CTLA-4 binding clones deposited under ATCC Accession No. PTA-125512.

The present disclosure further provides methods of making polypeptides. A variety of other expression/host systems may be utilized. Vector DNA can be introduced into prokaryotic or eukaryotic systems via conventional transformation or transfection techniques. These systems include but are not limited to microorganisms such as bacteria (for example, *E. coli*) transformed with recombinant bacteriophage, plasmid or cosmid DNA expression vectors; yeast transformed with yeast expression vectors; insect cell systems infected with virus expression vectors (e.g., baculovirus); plant cell systems transfected with virus expression vectors (e.g., cauliflower mosaic virus, CaMV; tobacco mosaic virus, TMV) or transformed with bacterial expression vectors (e.g., Ti or pBR322 plasmid); or animal cell systems. Mammalian cells useful in recombinant protein production include but are not limited to VERO cells, HeLa cells, Chinese hamster ovary (CHO) cell lines, or their derivatives such as Veggie CHO and related cell lines which grow in serum-free media (see Rasmussen et al., 1998, Cytotechnology 28:31) or CHO strain DX-B11, which is deficient in DHFR (see Urlaub et al., 1980, Proc. Natl. Acad. Sci. USA 77:4216-20) COS cells such as the COS-7 line of monkey kidney cells (ATCC CRL 1651) (see Gluzman et al., 1981, Cell 23:175), W138, BHK, HepG2, 3T3 (ATCC CCL 163), RIN, MDCK, A549, PC12, K562, L cells, C127 cells, BHK (ATCC CRL 10) cell lines, the CV1/EBNA cell line derived from the African green monkey kidney cell line CV1 (ATCC CCL 70) (see McMahan et al., 1991, EMBO J. 10:2821), human embryonic kidney cells such as 293, 293 EBNA or MSR 293, human epidermal A431 cells, human Colo205 cells, other transformed primate cell lines, normal diploid cells, cell strains derived from in vitro culture of primary tissue, primary explants, HL-60, U937, HaK or Jurkat cells. Mammalian expression allows for the production of secreted or soluble polypeptides which may be recovered from the growth medium.

For stable transfection of mammalian cells, it is known that, depending upon the expression vector and transfection technique used, only a small fraction of cells may integrate the foreign DNA into their genome. In order to identify and select these integrants, a gene that encodes a selectable marker (e.g., for resistance to antibiotics) is generally introduced into the host cells along with the gene of interest. Once such cells are transformed with vectors that contain selectable markers as well as the desired expression cassette, the cells can be allowed to grow in an enriched media before they are switched to selective media, for example. The selectable marker is designed to allow growth and recovery of cells that successfully express the introduced sequences. Resistant clumps of stably transformed cells can be proliferated using tissue culture techniques appropriate to the cell line employed. An overview of expression of recombinant proteins is found in Methods of Enzymology, v. 185, Goeddell, D. V., ed., Academic Press (1990). Preferred selectable markers include those which confer resistance to drugs, such as G418, hygromycin and methotrexate. Cells stably transfected with the introduced nucleic acid can be identified by drug selection (e.g., cells that have incorporated the selectable marker gene will survive, while the other cells die), among other methods.

The transformed cells can be cultured under conditions that promote expression of the polypeptide, and the polypeptide recovered by conventional protein purification procedures (as defined above). One such purification procedure includes the use of affinity chromatography, e.g., over a matrix having all or a portion (e.g., the extracellular domain) of CTLA-4 bound thereto. Polypeptides contemplated for use herein include substantially homogeneous recombinant mammalian anti-CTLA-4 antibody polypeptides substantially free of contaminating endogenous materials.

In some cases, such as in expression using prokaryotic systems, the expressed polypeptides of this disclosure may need to be "refolded" and oxidized into a proper tertiary structure and disulfide linkages generated in order to be biologically active. Refolding can be accomplished using a number of procedures well known in the art. Such methods include, for example, exposing the solubilized polypeptide to a pH usually above 7 in the presence of a chaotropic agent. The selection of chaotrope is similar to the choices used for inclusion body solubilization; however a chaotrope is typically used at a lower concentration. Exemplary chaotropic agents are guanidine and urea. In most cases, the refolding/oxidation solution will also contain a reducing agent plus its oxidized form in a specific ratio to generate a particular redox potential which allows for disulfide shuffling to occur for the formation of cysteine bridges. Some commonly used redox couples include cysteine/cystamine, glutathione/dithiobisGSH, cupric chloride, dithiothreitol DTT/dithiane DTT, and 2-mercaptoethanol (bME)/dithio-bME. In many instances, a co-solvent may be used to increase the efficiency of the refolding. Commonly used cosolvents include glycerol, polyethylene glycol of various molecular weights, and arginine.

In addition, the polypeptides can be synthesized in solution or on a solid support in accordance with conventional techniques. Various automatic synthesizers are commercially available and can be used in accordance with known protocols. See, for example, Stewart and Young, Solid Phase Peptide Synthesis, 2d. Ed., Pierce Chemical Co. (1984); Tam et al., J Am Chem Soc, 105:6442, (1983); Merrifield, Science 232:341-347 (1986); Barany and Merrifield, The Peptides, Gross and Meienhofer, eds, Academic Press, New York, 1-284; Barany et al., Int J Pep Protein Res, 30:705-739 (1987).

The polypeptides and proteins of the present disclosure can be purified according to protein purification techniques well known to those of skill in the art. These techniques involve, at one level, the crude fractionation of the proteinaceous and non-proteinaceous fractions. Having separated the peptide polypeptides from other proteins, the peptide or polypeptide of interest can be further purified using chromatographic and electrophoretic techniques to achieve partial or complete purification (or purification to homogeneity). The term "purified polypeptide" as used herein, is intended to refer to a composition, isolatable from other components, wherein the polypeptide is purified to any degree relative to its naturally-obtainable state. A purified polypeptide therefore also refers to a polypeptide that is free from the environment in which it may naturally occur. Generally, "purified" will refer to a polypeptide composition that has been subjected to fractionation to remove various other components, and which composition substantially retains its expressed biological activity. Where the term "substantially purified" is used, this designation will refer to a peptide or polypeptide composition in which the polypeptide or peptide forms the major component of the composition, such as constituting about 50%, about 60%, about 70%, about 80%, about 85%, or about 90% or more of the proteins in the composition.

Various techniques suitable for use in purification will be well known to those of skill in the art. These include, for example, precipitation with ammonium sulphate, PEG, antibodies (immunoprecipitation) and the like or by heat denaturation, followed by centrifugation; chromatography such as affinity chromatography (Protein-A columns), ion exchange, gel filtration, reverse phase, hydroxylapatite, hydrophobic interaction chromatography, isoelectric focusing, gel electrophoresis, and combinations of these techniques. As is generally known in the art, it is believed that the order of conducting the various purification steps may be changed, or that certain steps may be omitted, and still result in a suitable method for the preparation of a substantially purified polypeptide. Exemplary purification steps are provided in the Examples below.

Various methods for quantifying the degree of purification of polypeptide will be known to those of skill in the art in light of the present disclosure. These include, for example, determining the specific binding activity of an active fraction, or assessing the amount of peptide or polypeptide within a fraction by SDS/PAGE analysis. A preferred method for assessing the purity of a polypeptide fraction is to calculate the binding activity of the fraction, to compare it to the binding activity of the initial extract, and to thus calculate the degree of purification, herein assessed by a "-fold purification number." The actual units used to represent the amount of binding activity will, of course, be dependent upon the particular assay technique chosen to follow the purification and whether or not the polypeptide or peptide exhibits a detectable binding activity.

7.5. Antibody

CTLA-4 antibodies can be purified from host cells that have been transfected by a gene encoding the antibodies by elution of filtered supernatant of host cell culture fluid using a Heparin HP column, using a salt gradient.

A Fab fragment is a monovalent fragment having the $V_L$, $V_H$, $C_L$ and $C_{H1}$ domains; a F(ab')$_2$ fragment is a bivalent fragment having two Fab fragments linked by a disulfide bridge at the hinge region; a Fd fragment has the $V_H$ and $C_{H1}$ domains; an Fv fragment has the $V_L$ and $V_H$ domains of a single arm of an antibody; and a dAb fragment has a $V_H$ domain, a $V_L$ domain, or an antigen-binding fragment of a $V_H$ or $V_L$ domain (U.S. Pat. Nos. 6,846,634, 6,696,245, US App. Pub. Ser. No. 05/0202512, 04/0202995, 04/0038291, 04/0009507, 03/0039958, Ward et al., Nature 341:544-546, 1989).

Polynucleotide and polypeptide sequences of particular light and heavy chain variable domains are described below. Antibodies comprising a light chain and heavy chain are designated by combining the name of the light chain and the name of the heavy chain variable domains. For example, "L4H7," indicates an antibody comprising the light chain variable domain of L4 (comprising a sequence of SEQ ID NO:4) and the heavy chain variable domain of H7 (comprising a sequence of SEQ ID NO:107). Light chain variable sequences are provided in SEQ ID Nos: 1-28, and heavy chain variable sequences are provided in SEQ ID Nos:101-128.

In other embodiments, an antibody may comprise a specific heavy or light chain, while the complementary light or heavy chain variable domain remains unspecified. In particular, certain embodiments herein include antibodies that bind a specific antigen (such as CTLA-4) by way of a specific light or heavy chain, such that the complementary heavy or light chain may be promiscuous, or even irrelevant, but may be determined by, for example, screening combinatorial libraries. Portolano et al., J. Immunol. V. 150 (3), pp. 880-887 (1993); Clackson et al., Nature v. 352 pp. 624-628 (1991); Adler et al., A natively paired antibody library yields drug leads with higher sensitivity and specificity than a randomly paired antibody library, MAbs (2018)); Adler et al., Rare, high-affinity mouse anti-CTLA-4 antibodies that function in checkpoint blockade, discovered using microfluidics and molecular genomics, MAbs (2017).

Naturally occurring immunoglobulin chains exhibit the same general structure of relatively conserved framework regions (FR) joined by three hypervariable regions, also called complementarity determining regions or CDRs. From N-terminus to C-terminus, both light and heavy chains comprise the domains FR1, CDR1, FR2, CDR2, FR3, CDR3 and FR4. The assignment of amino acids to each domain is in accordance with the definitions of Kabat et al. in Sequences of Proteins of Immunological Interest, 5th Ed., US Dept. of Health and Human Services, PHS, NIH, NIH Publication no. 91-3242, 1991.

The term "human antibody," also referred to as "fully human antibody," includes all antibodies that have one or more variable and constant regions derived from human immunoglobulin sequences. In one embodiment, all of the variable and constant domains are derived from human immunoglobulin sequences (a fully human antibody). These antibodies may be prepared in a variety of ways, examples of which are described below, including through the immunization with an antigen of interest of a mouse that is genetically modified to express antibodies derived from human heavy and/or light chain-encoding genes.

A humanized antibody has a sequence that differs from the sequence of an antibody derived from a non-human species by one or more amino acid substitutions, deletions, and/or additions, such that the humanized antibody is less likely to induce an immune response, and/or induces a less severe immune response, as compared to the non-human species antibody, when it is administered to a human subject. In one embodiment, certain amino acids in the framework and constant domains of the heavy and/or light chains of the non-human species antibody are mutated to produce the humanized antibody. In another embodiment, the constant domain(s) from a human antibody are fused to the variable domain(s) of a non-human species. In another embodiment, one or more amino acid residues in one or more CDR sequences of a non-human antibody are changed to reduce the likely immunogenicity of the non-human antibody when it is administered to a human subject, wherein the changed amino acid residues either are not critical for immunospecific binding of the antibody to its antigen, or the changes to the amino acid sequence that are made are conservative changes, such that the binding of the humanized antibody to the antigen is not significantly worse than the binding of the non-human antibody to the antigen. Examples of how to make humanized antibodies may be found in U.S. Pat. Nos. 6,054,297, 5,886,152 and 5,877,293.

The term "chimeric antibody" refers to an antibody that contains one or more regions from one antibody and one or more regions from one or more other antibodies. In one embodiment, one or more of the CDRs are derived from a human anti-CTLA-4 antibody. In another embodiment, all of the CDRs are derived from a human anti-CTLA-4 antibody. In another embodiment, the CDRs from more than one human anti-CTLA-4 antibodies are mixed and matched in a chimeric antibody. For instance, a chimeric antibody may comprise a CDR1 from the light chain of a first human anti-CTLA-4 antibody, a CDR2 and a CDR3 from the light chain of a second human anti-CTLA-4 antibody, and the CDRs from the heavy chain from a third anti-CTLA-4 antibody. Further, the framework regions may be derived from one of the same anti-CTLA-4 antibodies, from one or more different antibodies, such as a human antibody, or from a humanized antibody. In one example of a chimeric antibody, a portion of the heavy and/or light chain is identical with, homologous to, or derived from an antibody from a particular species or belonging to a particular antibody class or subclass, while the remainder of the chain(s) is/are identical with, homologous to, or derived from an antibody (-ies) from another species or belonging to another antibody class or subclass. Also included are fragments of such antibodies that exhibit the desired biological activity (i.e., the ability to specifically bind CTLA-4).

Fragments or analogs of antibodies can be readily prepared by those of ordinary skill in the art following the teachings of this specification and using techniques well-known in the art. Preferred amino- and carboxy-termini of fragments or analogs occur near boundaries of functional domains. Structural and functional domains can be identified by comparison of the nucleotide and/or amino acid sequence data to public or proprietary sequence databases. Computerized comparison methods can be used to identify sequence motifs or predicted protein conformation domains that occur in other proteins of known structure and/or function. Methods to identify protein sequences that fold into a known three-dimensional structure are known. See, e.g., Bowie et al., 1991, Science 253:164.

Antigen binding fragments derived from an antibody can be obtained, for example, by proteolytic hydrolysis of the antibody, for example, pepsin or papain digestion of whole antibodies according to conventional methods. By way of example, antibody fragments can be produced by enzymatic cleavage of antibodies with pepsin to provide a 5S fragment termed $F(ab')_2$. This fragment can be further cleaved using a thiol reducing agent to produce 3.5S Fab' monovalent fragments. Optionally, the cleavage reaction can be performed using a blocking group for the sulfhydryl groups that result from cleavage of disulfide linkages. As an alternative, an enzymatic cleavage using papain produces two monovalent Fab fragments and an Fc fragment directly. These methods are described, for example, by Goldenberg, U.S. Pat. No. 4,331,647, Nisonoff et al., Arch. Biochem. Biophys. 89:230, 1960; Porter, Biochem. J. 73:119, 1959; Edelman et al., in Methods in Enzymology 1:422 (Academic Press 1967); and by Andrews, S. M. and Titus, J. A. in Current Protocols in Immunology (Coligan J. E., et al., eds), John Wiley & Sons, New York (2003), pages 2.8.1 2.8.10 and 2.10A.1 2.10A.5. Other methods for cleaving antibodies, such as separating heavy chains to form monovalent light heavy chain fragments (Fd), further cleaving of fragments, or other enzymatic, chemical, or genetic techniques may also be used, so long as the fragments bind to the antigen that is recognized by the intact antibody.

An antibody fragment may also be any synthetic or genetically engineered protein. For example, antibody fragments include isolated fragments consisting of the light chain variable region, "Fv" fragments consisting of the variable regions of the heavy and light chains, recombinant single chain polypeptide molecules in which light and heavy variable regions are connected by a peptide linker (scFv proteins).

Another form of an antibody fragment is a peptide comprising one or more complementarity determining regions (CDRs) of an antibody. CDRs (also termed "minimal recognition units", or "hypervariable region") can be incorporated into a molecule either covalently or noncovalently to make it an antigen binding protein. CDRs can be obtained by constructing polynucleotides that encode the CDR of interest. Such polynucleotides are prepared, for example, by using the polymerase chain reaction to synthesize the variable region using mRNA of antibody producing cells as a template (see, for example, Larrick et al., Methods: A Companion to Methods in Enzymology 2:106, 1991; Courtenay Luck, "Genetic Manipulation of Monoclonal Antibodies," in Monoclonal Antibodies: Production, Engineering and Clinical Application, Ritter et al. (eds.), page 166 (Cambridge University Press 1995); and Ward et al., "Genetic Manipulation and Expression of Antibodies," in Monoclonal Antibodies: Principles and Applications, Birch et al., (eds.), page 137 (Wiley Liss, Inc. 1995).

Thus, in one embodiment, the binding agent comprises at least one CDR as described herein. The binding agent may comprise at least two, three, four, five or six CDR's as described herein. The binding agent may further comprise at least one variable region domain of an antibody described herein. The variable region domain may be of any size or amino acid composition and will generally comprise at least one CDR sequence responsible for binding to human CTLA-4, for example CDR1-H, CDR2-H, CDR3-H, CDR1-L, CDR2-L, and CDR3-L, specifically described herein and which is adjacent to or in frame with one or more framework sequences. In general terms, the variable (V) region domain may be any suitable arrangement of immunoglobulin heavy ($V_H$) and/or light ($V_L$) chain variable domains. Thus, for example, the V region domain may be monomeric and be a $V_H$ or $V_L$ domain, which is capable of independently binding human CTLA-4 with an affinity at least equal to $1 \times 10^7 M$ or less as described below. Alternatively, the V region domain may be dimeric and contain $V_H$ $V_H$, $V_H$ $V_L$, or $V_L$ $V_L$, dimers. The V region dimer comprises at least one $V_H$ and at least one $V_L$ chain that may be non-covalently associated (hereinafter referred to as Fv). If desired, the chains may be covalently coupled either directly, for example via a disulfide bond between the two variable domains, or through a linker, for example a peptide linker, to form a single chain Fv (scFV).

The variable region domain may be any naturally occurring variable domain or an engineered version thereof. By engineered version is meant a variable region domain that has been created using recombinant DNA engineering techniques. Such engineered versions include those created, for example, from a specific antibody variable region by insertions, deletions, or changes in or to the amino acid sequences of the specific antibody. Particular examples include engineered variable region domains containing at least one CDR and optionally one or more framework amino acids from a first antibody and the remainder of the variable region domain from a second antibody.

The variable region domain may be covalently attached at a C terminal amino acid to at least one other antibody domain or a fragment thereof. Thus, for example, a $V_H$ domain that is present in the variable region domain may be linked to an immunoglobulin CH1 domain, or a fragment thereof. Similarly a $V_L$ domain may be linked to a CK domain or a fragment thereof. In this way, for example, the antibody may be a Fab fragment wherein the antigen binding domain contains associated $V_H$ and $V_L$ domains covalently linked at their C termini to a CH1 and CK domain, respectively. The CH1 domain may be extended with further amino acids, for example to provide a hinge region or a portion of a hinge region domain as found in a Fab' fragment, or to provide further domains, such as antibody $C_{H2}$ and $C_{H3}$ domains.

As described herein, antibodies comprise at least one of these CDRs. For example, one or more CDR may be incorporated into known antibody framework regions (IgG1, IgG2, etc.), or conjugated to a suitable vehicle to enhance the half-life thereof. Suitable vehicles include, but are not limited to Fc, polyethylene glycol (PEG), albumin, transferrin, and the like. These and other suitable vehicles are known in the art. Such conjugated CDR peptides may be in monomeric, dimeric, tetrameric, or other form. In one embodiment, one or more water-soluble polymer is bonded at one or more specific position, for example at the amino terminus, of a binding agent.

In another example, individual $V_L$ or $V_H$ chains from an antibody (i.e. CTLA-4 antibody) can be used to search for other $V_H$ or $V_L$ chains that could form antigen-binding fragments (or Fab), with the same specificity. Thus, random combinations of $V_H$ and $V_L$ chain Ig genes can be expressed as antigen-binding fragments in a bacteriophage library (such as fd or lambda phage). For instance, a combinatorial library may be generated by utilizing the parent $V_L$ or $V_H$ chain library combined with antigen-binding specific $V_L$ or $V_H$ chain libraries, respectively. The combinatorial libraries may then be screened by conventional techniques, for example by using radioactively labeled probe (such as radioactively labeled CTLA-4). See, for example, Portolano et al., J. Immunol. V. 150 (3) pp. 880-887 (1993).

Diabodies are bivalent antibodies comprising two polypeptide chains, wherein each polypeptide chain comprises $V_H$ and $V_L$ domains joined by a linker that is too short to allow for pairing between two domains on the same chain, thus allowing each domain to pair with a complementary domain on another polypeptide chain (see, e.g., Holliger et al., 1993, *Proc. Natl. Acad. Sci.* USA 90:6444-48, and Poljak et al., 1994, *Structure* 2:1121-23). If the two polypeptide chains of a diabody are identical, then a diabody resulting from their pairing will have two identical antigen binding sites. Polypeptide chains having different sequences can be used to make a diabody with two different antigen binding sites. Similarly, tribodies and tetrabodies are antibodies comprising three and four polypeptide chains, respectively, and forming three and four antigen binding sites, respectively, which can be the same or different.

Antibody polypeptides are also disclosed in U.S. Pat. No. 6,703,199, including fibronectin polypeptide monobodies. Other antibody polypeptides are disclosed in U.S. Patent Publication 2005/0238646, which are single-chain polypeptides.

In certain embodiments, an antibody comprises one or more water soluble polymer attachments, including, but not limited to, polyethylene glycol, polyoxyethylene glycol, or polypropylene glycol. See, e.g., U.S. Pat. Nos. 4,640,835, 4,496,689, 4,301,144, 4,670,417, 4,791,192 and 4,179,337. In certain embodiments, a derivative binding agent comprises one or more of monomethoxy-polyethylene glycol, dextran, cellulose, or other carbohydrate based polymers, poly-(N-vinyl pyrrolidone)-polyethylene glycol, propylene glycol homopolymers, a polypropylene oxide/ethylene oxide co-polymer, polyoxyethylated polyols (e.g., glycerol) and polyvinyl alcohol, as well as mixtures of such polymers. In certain embodiments, one or more water-soluble polymer is randomly attached to one or more side chains. In certain embodiments, PEG can act to improve the therapeutic capacity for a binding agent, such as an antibody. Certain such methods are discussed, for example, in U.S. Pat. No. 6,133,426, which is hereby incorporated by reference for any purpose.

7.6. Antigen Binding Protein

In one aspect, the present disclosure provides antigen binding proteins (e.g., antibodies, antibody fragments, antibody derivatives, antibody muteins, and antibody variants), that bind to CTLA-4.

An antigen binding protein can have, for example, the structure of a naturally occurring immunoglobulin. An "immunoglobulin" is a tetrameric molecule. In a naturally occurring immunoglobulin, each tetramer is composed of two identical pairs of polypeptide chains, each pair having one "light" (about 25 kDa) and one "heavy" chain (about 50-70 kDa). The amino-terminal portion of each chain includes a variable region of about 100 to 110 or more amino acids primarily responsible for antigen recognition. The carboxy-terminal portion of each chain defines a constant region primarily responsible for effector function. Human light chains are classified as kappa and lambda light chains. Heavy chains are classified as mu, delta, gamma, alpha, or epsilon, and define the antibody's isotype as IgM, IgD, IgG, IgA, and IgE, respectively. Within light and heavy chains, the variable and constant regions are joined by a "J" region of about 12 or more amino acids, with the heavy chain also including a "D" region of about 10 more amino acids. See generally, Fundamental Immunology Ch. 7 (Paul, W., ed., 2nd ed. Raven Press, N.Y. (1989)) (incorporated by reference in its entirety for all purposes). The variable regions of each light/heavy chain pair form the antibody binding site such that an intact immunoglobulin has two binding sites.

Antigen binding proteins in accordance with the present disclosure include antigen binding proteins that inhibit a biological activity of CTLA-4.

Different antigen binding proteins may bind to different domains of CTLA-4 or act by different mechanisms of action. As indicated herein inter alia, the domain region are designated such as to be inclusive of the group, unless otherwise indicated. For example, amino acids 4-12 refers to nine amino acids: amino acids at positions 4, and 12, as well as the seven intervening amino acids in the sequence. Other examples include antigen binding proteins that inhibit binding of CTLA-4 to its ligands. An antigen binding protein need not completely inhibit a (CTLA-4-induced activity to find use in the present disclosure; rather, antigen binding proteins that reduce a particular activity of CTLA-4 are contemplated for use as well. (Discussions herein of particular mechanisms of action for CTLA-4-binding antigen binding proteins in treating particular diseases are illustrative only, and the methods presented herein are not bound thereby.)

In another aspect, the present disclosure provides antigen binding proteins that comprise a light chain variable region selected from the group consisting of A1LC-A28LC or a heavy chain variable region selected from the group consisting of A1HC-A28HC, and fragments, derivatives, muteins, and variants thereof. Such an antigen binding protein can be denoted using the nomenclature "LxHy," wherein "x" corresponds to the number of the light chain variable region and "y" corresponds to the number of the heavy chain variable region as they are labeled in the sequences below. That is to say, for example, that "A1HC" denotes the heavy chain variable region comprising the amino acid sequence of SEQ ID NO: 101; "A1LC" denotes the light chain variable region comprising the amino acid sequence of SEQ ID NO:1, and so forth. More generally speaking, "L2H1" refers to an antigen binding protein with a light chain variable region comprising the amino acid sequence of L2 (SEQ ID NO:2) and a heavy chain variable region comprising the amino acid sequence of H1 (SEQ ID NO:101). For clarity, all ranges denoted by at least two members of a group include all members of the group between and including the end range members. Thus, the group range A1-A28, includes all members between A1 and A28, as well as members A1 and A28 themselves. The group range A4-A6 includes members A4, A5, and A6, etc.

In some embodiments, antigen binding proteins comprise variable (V(D)J) regions of both heavy and light chain sequences identical to one of the clones in the library of CTLA-4 binding clones, deposited under ATCC Accession NO. PTA-125512. In some embodiments, antigen binding proteins comprise variable (V(D)J) regions of either heavy or light chain sequence identical to one of the clones in the library of CTLA-4 binding clones, deposited under ATCC Accession NO. PTA-125512. In some embodiments, antigen binding proteins are expressed from the expression vector in one of the clones in the library of CTLA-4 binding clones, deposited under ATCC Accession NO. PTA-125512.

Also shown below are the locations of the CDRs (underlined) that create part of the antigen-binding site, while the Framework Regions (FRs) are the intervening segments of these variable domain sequences. In both light chain variable regions and heavy chain variable regions there are three CDRs (CDR1-3) and four FRs (FR 1-4). The CDR regions of each light and heavy chain also are grouped by antibody type (A1, A2, A3, etc.). Antigen binding proteins of the present disclosure include, for example, antigen binding proteins having a combination of light chain and heavy chain variable domains selected from the group of combinations consisting of L1H1 (antibody A1), L2H2 (antibody A2), L3H3 (antibody A3), L4H4 (antibody A4), L5H5 (antibody A5), L6H6 (antibody A6), L7H7 (antibody A7), L8H8 (antibody A8), L9H9 (antibody A9), L10H10 (antibody A10), L11H11 (antibody A1 l), L12H12 (antibody A12), L13H13 (antibody A13), . . . and L28H28 (antibody A28).

In some embodiments, antigen binding proteins comprise all six CDR sequences (three CDRs of light chain and three CDRs of heavy chain) identical to one of the clones in the library of CTLA-4 binding clones, deposited under ATCC Accession NO. PTA-125512. In some embodiments, antigen binding proteins comprise three out of six CDR sequences (three CDRs of light chain or three CDRs of heavy chain) identical to one of the clones in the library of CTLA-4 binding clones, deposited under ATCC Accession NO. PTA-125512. In some embodiments, antigen binding proteins comprise one, two, three, four, or five out of six CDR sequences identical to one of the clones in the library of CTLA-4 binding clones, deposited under ATCC Accession NO. PTA-125512.

In one embodiment, the present disclosure provides an antigen binding protein comprising a light chain variable domain comprising a sequence of amino acids that differs from the sequence of a light chain variable domain selected from the group consisting of L1 through L28 only at 15, 14, 13, 12, 11, 10, 9, 8, 7, 6, 5, 4, 3, 2, or 1 residues, wherein each such sequence difference is independently either a deletion, insertion, or substitution of one amino acid residue. In another embodiment, the light-chain variable domain comprises a sequence of amino acids that is at least 70%, 75%, 80%, 85%, 90%, 95%, 96%, 97%, 98%, or 99% identical to the sequence of a light chain variable domain selected from the group consisting of L1-L28. In another embodiment, the light chain variable domain comprises a sequence of amino acids that is encoded by a nucleotide sequence that is at least 70%, 75%, 80%, 85%, 90%, 95%, 96%, 97%, 98%, or 99% identical to a nucleotide sequence that encodes a light chain variable domain selected from the group consisting of L1-L28 (which includes L1, L2, L3, L4, L5, L6, L7, L8, L9, L10, L11, L12, L13, . . . and L28). In another embodiment, the light chain variable domain comprises a sequence of amino acids that is encoded by a polynucleotide that hybridizes under moderately stringent conditions to the complement of a polynucleotide that encodes a light chain variable domain selected from the group consisting of L1-L28. In another embodiment, the light chain variable domain comprises a sequence of amino acids that is encoded by a polynucleotide that hybridizes under moderately stringent conditions to the complement of a polynucleotide that encodes a light chain variable domain selected from the group consisting of L1-L28. In another embodiment, the light chain variable domain comprises a sequence of amino acids that is encoded by a polynucleotide that hybridizes under moderately stringent conditions to a complement of a light chain polynucleotide of L1-L28.

In one embodiment, the present disclosure provides an antigen binding protein comprising a light chain variable domain comprising a sequence of amino acids that differs from the sequence of a light chain variable domain encoded by one of the clones of the library of CTLA-4 binding clones, deposited under ATCC Accession NO. PTA-125512, only at 15, 14, 13, 12, 11, 10, 9, 8, 7, 6, 5, 4, 3, 2, or 1 residues, wherein each such sequence difference is independently either a deletion, insertion, or substitution of one amino acid residue. In another embodiment, the light-chain variable domain comprises a sequence of amino acids that is at least 70%, 75%, 80%, 85%, 90%, 95%, 96%, 97%, 98%, or 99% identical to the sequence of a light chain variable domain encoded by one of the clones of the library of CTLA-4 binding clones, deposited under ATCC Accession NO. PTA-125512. In another embodiment, the light chain variable domain comprises a sequence of amino acids that is encoded by a nucleotide sequence that is at least 70%, 75%, 80%, 85%, 90%, 95%, 96%, 97%, 98%, or 99% identical to a nucleotide sequence of one of the clones of the library of CTLA-4 binding clones, deposited under ATCC Accession NO. PTA-125512.

In another embodiment, the present disclosure provides an antigen binding protein comprising a heavy chain variable domain comprising a sequence of amino acids that differs from the sequence of a heavy chain variable domain selected from the group consisting of H1-H28 only at 15, 14, 13, 12, 11, 10, 9, 8, 7, 6, 5, 4, 3, 2, or 1 residue(s), wherein each such sequence difference is independently either a deletion, insertion, or substitution of one amino acid residue. In another embodiment, the heavy chain variable domain comprises a sequence of amino acids that is at least 70%, 75%, 80%, 85%, 90%, 95%, 96%, 97%, 98%, or 99% identical to the sequence of a heavy chain variable domain selected from the group consisting of H1-H28. In another embodiment, the heavy chain variable domain comprises a sequence of amino acids that is encoded by a nucleotide sequence that is at least 70%, 75%, 80%, 85%, 90%, 95%, 96%, 97%, 98%, or 99% identical to a nucleotide sequence that encodes a heavy chain variable domain selected from the group consisting of H1-H28. In another embodiment, the heavy chain variable domain comprises a sequence of amino acids that is encoded by a polynucleotide that hybridizes under moderately stringent conditions to the complement of a polynucleotide that encodes a heavy chain variable domain selected from the group consisting of H1-H28. In another embodiment, the heavy chain variable domain comprises a sequence of amino acids that is encoded by a polynucleotide that hybridizes under moderately stringent conditions to the complement of a polynucleotide that encodes a heavy chain variable domain selected from the group consisting of H1-H28. In another embodiment, the heavy chain variable domain comprises a sequence of amino acids that is encoded by a polynucleotide that hybridizes under moderately stringent conditions to a complement of a heavy chain polynucleotide disclosed herein.

In one embodiment, the present disclosure provides an antigen binding protein comprising a heavy chain variable domain comprising a sequence of amino acids that differs from the sequence of a heavy chain variable domain encoded by one of the clones of the library of CTLA-4 binding clones, deposited under ATCC Accession NO. PTA-125512, only at 15, 14, 13, 12, 11, 10, 9, 8, 7, 6, 5, 4, 3, 2, or 1 residues, wherein each such sequence difference is independently either a deletion, insertion, or substitution of one amino acid residue. In another embodiment, the heavy chain variable domain comprises a sequence of amino acids that is at least 70%, 75%, 80%, 85%, 90%, 95%, 96%, 97%, 98%, or 99% identical to the sequence of a heavy chain variable domain encoded by one of the clones of the library of CTLA-4 binding clones, deposited under ATCC Accession NO. PTA-125512. In another embodiment, the heavy chain variable domain comprises a sequence of amino acids that is encoded by a nucleotide sequence that is at least 70%, 75%, 80%, 85%, 90%, 95%, 96%, 97%, 98%, or 99% identical to a nucleotide sequence of one of the clones of the library of CTLA-4 binding clones, deposited under ATCC Accession NO. PTA-125512.

Particular embodiments of antigen binding proteins of the present disclosure comprise one or more amino acid sequences that are identical to the amino acid sequences of one or more of the CDRs and/or FRs referenced herein. In one embodiment, the antigen binding protein comprises a light chain CDR1 sequence illustrated above. In another embodiment, the antigen binding protein comprises a light chain CDR2 sequence illustrated above. In another embodiment, the antigen binding protein comprises a light chain CDR3 sequence illustrated above. In another embodiment, the antigen binding protein comprises a heavy chain CDR1 sequence illustrated above. In another embodiment, the antigen binding protein comprises a heavy chain CDR2 sequence illustrated above. In another embodiment, the antigen binding protein comprises a heavy chain CDR3 sequence illustrated above.

In one embodiment, the present disclosure provides an antigen binding protein that comprises one or more CDR sequences that differ from a CDR sequence shown above by no more than 5, 4, 3, 2, or 1 amino acid residues.

In some embodiments, at least one of the antigen binding protein's CDR1 sequences is a CDR1 sequence from A1-A28, CDR1-L1 to 28, or CDR1-H1 to 28 as shown in TABLE 5. In some embodiments, at least one of the antigen binding protein's CDR2 sequences is a CDR2 sequence from A1-A28, CDR2-L1 to 28, or CDR2-H1 to 28 as shown in TABLE 5. In some embodiments, at least one of the antigen binding protein's CDR3 sequences is a CDR3 sequence from A1-A28, CDR3-L1 to 28, or CDR3-H1 to 28 as shown in TABLE 5.

In another embodiment, the antigen binding protein's light chain CDR3 sequence is a light chain CDR3 sequence from A1-A28 or CDR3-L1 to 28, as shown in TABLE 5, and the antigen binding protein's heavy chain CDR3 sequence is a heavy chain sequence from A1-A28 or CDR-H1 to 28, as shown in TABLE 5.

In another embodiment, the antigen binding protein comprises 1, 2, 3, 4, or 5 CDR sequence(s) that each independently differs by 6, 5, 4, 3, 2, 1, or 0 single amino acid additions, substitutions, and/or deletions from a CDR sequence of A1-A23, and the antigen binding protein further comprises 1, 2, 3, 4, or 5 CDR sequence(s) that each independently differs by 6, 5, 4, 3, 2, 1, or 0 single amino acid additions, substitutions, and/or deletions from a CDR sequence. In some embodiments, the antigen binding protein comprises 1, 2, 3, 4, or 5 CDR sequence(s) that each has at least 50%, 55%, 60%, 65%, 70%, 75%, 80%, 85%, 90%, 95%, 96%, 97%, 98%, or 99% sequence identity to a CDR sequence of A1-A28.

The nucleotide sequences of A1-A28, or the amino acid sequences of A1-A28, can be altered, for example, by random mutagenesis or by site-directed mutagenesis (e.g., oligonucleotide-directed site-specific mutagenesis) to create an altered polynucleotide comprising one or more particular nucleotide substitutions, deletions, or insertions as compared to the non-mutated polynucleotide. Examples of techniques for making such alterations are described in Walder et al., 1986, Gene 42:133; Bauer et al. 1985, Gene 37:73; Craik, BioTechniques, January 1985, 12-19; Smith et al., 1981, *Genetic Engineering: Principles and Methods*, Plenum Press; and U.S. Pat. Nos. 4,518,584 and 4,737,462. These and other methods can be used to make, for example, derivatives of anti-CTLA-4 antibodies that have a desired property, for example, increased affinity, avidity, or specificity for CTLA-4, increased activity or stability in vivo or in vitro, or reduced in vivo side-effects as compared to the underivatized antibody.

Other derivatives of anti-CTLA-4 antibodies within the scope of this disclosure include covalent or aggregative conjugates of anti-CTLA-4 antibodies, or fragments thereof, with other proteins or polypeptides, such as by expression of recombinant fusion proteins comprising heterologous polypeptides fused to the N-terminus or C-terminus of an anti-CTLA-4 antibody polypeptide. For example, the conjugated peptide may be a heterologous signal (or leader) polypeptide, e.g., the yeast alpha-factor leader, or a peptide such as an epitope tag. Antigen binding protein-containing fusion proteins can comprise peptides added to facilitate purification or identification of antigen binding protein (e.g., poly-His). An antigen binding protein also can be linked to the FLAG peptide Asp-Tyr-Lys-Asp-Asp-Asp-Asp-Lys (DYKDDDDK) (SEQ ID NO: 7002) as described in Hopp et al., *Bio/Technology* 6:1204, 1988, and U.S. Pat. No. 5,011,912. The FLAG peptide is highly antigenic and provides an epitope reversibly bound by a specific monoclonal antibody (mAb), enabling rapid assay and facile purification of expressed recombinant protein. Reagents useful for preparing fusion proteins in which the FLAG peptide is fused to a given polypeptide are commercially available (Sigma, St. Louis, MO).

One suitable Fc polypeptide, described in PCT application WO 93/10151 (hereby incorporated by reference), is a single chain polypeptide extending from the N-terminal hinge region to the native C-terminus of the Fc region of a human IgG1 antibody. Another useful Fc polypeptide is the Fc mutein described in U.S. Pat. No. 5,457,035 and in Baum et al., 1994, EMBO J. 13:3992-4001. The amino acid sequence of this mutein is identical to that of the native Fc sequence presented in WO 93/10151, except that amino acid 19 has been changed from Leu to Ala, amino acid 20 has been changed from Leu to Glu, and amino acid 22 has been changed from Gly to Ala. The mutein exhibits reduced affinity for Fc receptors.

In other embodiments, the variable portion of the heavy and/or light chains of an anti-CTLA-4 antibody may be substituted for the variable portion of an antibody heavy and/or light chain.

Oligomers that contain one or more antigen binding proteins may be employed as CTLA-4 antagonists or agonists. Oligomers may be in the form of covalently-linked or non-covalently-linked dimers, trimers, or higher oligomers. Oligomers comprising two or more antigen binding protein are contemplated for use, with one example being a homodimer. Other oligomers include heterodimers, homotrimers, heterotrimers, homotetramers, heterotetramers, etc.

One embodiment is directed to oligomers comprising multiple antigen binding proteins joined via covalent or non-covalent interactions between peptide moieties fused to the antigen binding proteins. Such peptides may be peptide linkers (spacers), or peptides that have the property of promoting oligomerization. Leucine zippers and certain polypeptides derived from antibodies are among the peptides that can promote oligomerization of antigen binding proteins attached thereto, as described in more detail below.

In particular embodiments, the oligomers comprise from two to four antigen binding proteins. The antigen binding proteins of the oligomer may be in any form, such as any of the forms described above, e.g., variants or fragments. Preferably, the oligomers comprise antigen binding proteins that have CTLA-4 binding activity.

In one embodiment, an oligomer is prepared using polypeptides derived from immunoglobulins. Preparation of fusion proteins comprising certain heterologous polypeptides fused to various portions of antibody-derived polypeptides (including the Fc domain) has been described, e.g., by Ashkenazi et al., 1991, PNAS USA 88:10535; Byrn et al., 1990, Nature 344:677; and Hollenbaugh et al., 1992 *Curr. Prots in Immunol.*, Suppl. 4, pages 10.19.1-10.19.11.

One embodiment of the present disclosure is directed to a dimer comprising two fusion proteins created by fusing a CTLA-4 binding fragment of an anti-CTLA-4 antibody to the Fc region of an antibody. The dimer can be made by, for example, inserting a gene fusion encoding the fusion protein into an appropriate expression vector, expressing the gene fusion in host cells transformed with the recombinant expression vector, and allowing the expressed fusion protein to assemble much like antibody molecules, whereupon interchain disulfide bonds form between the Fc moieties to yield the dimer.

Alternatively, the oligomer is a fusion protein comprising multiple antigen binding proteins, with or without peptide linkers (spacer peptides). Among the suitable peptide linkers are those described in U.S. Pat. Nos. 4,751,180 and 4,935,233.

Another method for preparing oligomeric antigen binding proteins involves use of a leucine zipper. Leucine zipper domains are peptides that promote oligomerization of the proteins in which they are found. Leucine zippers were originally identified in several DNA-binding proteins (Landschulz et al., 1988, Science 240:1759), and have since been found in a variety of different proteins. Among the known leucine zippers are naturally occurring peptides and derivatives thereof that dimerize or trimerize. Examples of leucine zipper domains suitable for producing soluble oligomeric proteins are described in PCT application WO 94/10308, and the leucine zipper derived from lung surfactant protein D (SPD) described in Hoppe et al., 1994, FEBS Letters 344:191, hereby incorporated by reference. The use of a modified leucine zipper that allows for stable trimerization of a heterologous protein fused thereto is described in Fanslow et al., 1994, Semin. Immunol. 6:267-78. In one approach, recombinant fusion proteins comprising an anti-CTLA-4 antibody fragment or derivative fused to a leucine zipper peptide are expressed in suitable host cells, and the soluble oligomeric anti-CTLA-4 antibody fragments or derivatives that form are recovered from the culture supernatant.

In one aspect, the present disclosure provides antigen binding proteins that interfere with the binding of CTLA-4 to its ligands. Such antigen binding proteins can be made against CTLA-4, or a fragment, variant or derivative thereof, and screened in conventional assays for the ability to interfere with binding of CTLA-4 to its ligands. Examples of suitable assays are assays that test the antigen binding proteins for the ability to inhibit binding of CTLA-4 ligands to cells expressing CTLA-4, or that test antigen binding proteins for the ability to reduce a biological or cellular response that results from the binding of CTLA-4 ligands to cell surface CTLA-4. For example, antibodies can be screened according to their ability to bind to immobilized antibody surfaces (CTLA-4). Antigen binding proteins that block the binding of CTLA-4 to a ligand can be employed in treating any CTLA-4-related condition, including but not limited to cancer. In an embodiment, a human anti-CTLA-4 monoclonal antibody generated by procedures involving immunization of transgenic mice is employed in treating such conditions.

Antigen-binding fragments of antigen binding proteins of the present disclosure can be produced by conventional techniques. Examples of such fragments include, but are not limited to, Fab and F(ab')$_2$ fragments. Antibody fragments and derivatives produced by genetic engineering techniques also are contemplated.

Additional embodiments include chimeric antibodies, e.g., humanized versions of non-human (e.g., murine) monoclonal antibodies. Such humanized antibodies may be prepared by known techniques, and offer the advantage of reduced immunogenicity when the antibodies are administered to humans. In one embodiment, a humanized monoclonal antibody comprises the variable domain of a murine antibody (or all or part of the antigen binding site thereof) and a constant domain derived from a human antibody. Alternatively, a humanized antibody fragment may comprise the antigen binding site of a murine monoclonal antibody and a variable domain fragment (lacking the antigen-binding site) derived from a human antibody. Procedures for the production of chimeric and further engineered monoclonal antibodies include those described in Riechmann et al., 1988, Nature 332:323, Liu et al., 1987, Proc. Nat. Acad. Sci. USA 84:3439, Larrick et al., 1989, Bio/Technology 7:934, and Winter et al., 1993, TIPS 14:139. In one embodiment, the chimeric antibody is a CDR grafted antibody. Techniques for humanizing antibodies are discussed in, e.g., U.S. Pat. Nos. 5,869,619, 5,225,539, 5,821,337, 5,859,205, 6,881,557, Padlan et al., 1995, FASEB J. 9:133-39, and Tamura et al., 2000, J. Immunol. 164:1432-41.

Procedures have been developed for generating human or partially human antibodies in non-human animals. For example, mice in which one or more endogenous immunoglobulin genes have been inactivated by various means have been prepared. Human immunoglobulin genes have been introduced into the mice to replace the inactivated mouse genes. Antibodies produced in the animal incorporate human immunoglobulin polypeptide chains encoded by the human genetic material introduced into the animal. In one embodiment, a non-human animal, such as a transgenic mouse, is immunized with a CTLA-4 polypeptide, such that antibodies directed against the CTLA-4 polypeptide are generated in the animal.

One example of a suitable immunogen is a soluble human CTLA-4, such as a polypeptide comprising the extracellular domain of the protein having the following sequence: SEQ ID: 7001 or other immunogenic fragment of the protein. Examples of techniques for production and use of transgenic animals for the production of human or partially human antibodies are described in U.S. Pat. Nos. 5,814,318, 5,569, 825, and 5,545,806, Davis et al., 2003, Production of human antibodies from transgenic mice in Lo, ed. Antibody Engineering: Methods and Protocols, Humana Press, NJ:191-200, Kellermann et al., 2002, *Curr Opin Biotechnol.* 13:593-97, Russel et al., 2000, *Infect Immun.* 68:1820-26, Gallo et al., 2000, *Eur J Immun.* 30:534-40, Davis et al., 1999, *Cancer Metastasis Rev.* 18:421-25, Green, 1999, *J Immunol Methods.* 231:11-23, Jakobovits, 1998, *Advanced Drug Delivery Reviews* 31:33-42, Green et al., 1998, *J Exp Med.* 188:483-95, Jakobovits A, 1998, *Exp. Opin. Invest. Drugs.* 7:607-14, Tsuda et al., 1997, *Genomics.* 42:413-21, Mendez et al., 1997, *Nat Genet.* 15:146-56, Jakobovits, 1994, *Curr Biol.* 4:761-63, Arbones et al., 1994, *Immunity.* 1:247-60, Green et al., 1994, *Nat Genet.* 7:13-21, Jakobovits et al., 1993, Nature. 362:255-58, Jakobovits et al., 1993, *Proc Natl Acad Sci USA.* 90:2551-55. Chen, J., M. Trounstine, F. W. Alt, F. Young, C. Kuraraha, J. Loring, D. Huszar. *Inter'l Immunol.* 5 (1993): 647-656, Choi et al., 1993, *Nature Genetics* 4: 117-23, Fishwild et al., 1996, *Nature Biotech.* 14: 845-51, Harding et al., 1995, Annals of the New York Academy of Sciences, Lonberg et al., 1994, Nature 368: 856-59, Lonberg, 1994, Transgenic Approaches to Human Monoclonal Antibodies in Handbook of Experimental Pharmacology 113: 49-101, Lonberg et al., 1995, Internal Review of Immunology 13: 65-93, Neuberger, 1996, *Nature Biotechnology* 14: 826, Taylor et al., 1992, *Nucleic Acids Res.* 20: 6287-95, Taylor et al., 1994, *Inter'l Immunol.* 6: 579-91, Tomizuka et al., 1997, *Nature Genetics* 16: 133-43, Tomizuka et al., 2000, *Pro. Nat'l Acad.* Sci. USA 97: 722-27, Tuaillon et al., 1993, *Pro. Nat'l Acad. Sci.* USA 90: 3720-24, and Tuaillon et al., 1994, *J. Immunol.* 152: 2912-20.

Antigen binding proteins (e.g., antibodies, antibody fragments, and antibody derivatives) of the present disclosure can comprise any constant region known in the art. The light chain constant region can be, for example, a kappa- or lambda-type light chain constant region, e.g., a human kappa- or lambda-type light chain constant region. The heavy chain constant region can be, for example, an alpha-, delta-, epsilon-, gamma-, or mu-type heavy chain constant regions, e.g., a human alpha-, delta-, epsilon-, gamma-, or mu-type heavy chain constant region. In one embodiment, the light or heavy chain constant region is a fragment, derivative, variant, or mutein of a naturally occurring constant region.

Techniques are known for deriving an antibody of a different subclass or isotype from an antibody of interest, i.e., subclass switching. Thus, IgG antibodies may be derived from an IgM antibody, for example, and vice versa. Such techniques allow the preparation of new antibodies that possess the antigen-binding properties of a given antibody (the parent antibody), but also exhibit biological properties associated with an antibody isotype or subclass different from that of the parent antibody. Recombinant DNA techniques may be employed. Cloned DNA encoding particular antibody polypeptides may be employed in such procedures, e.g., DNA encoding the constant domain of an antibody of the desired isotype. See also Lantto et al., 2002, *Methods Mol. Biol.* 178:303-16.

In one embodiment, an antigen binding protein of the present disclosure comprises the IgG1 heavy chain domain of any of A1-A28 (H1-H28) or a fragment of the IgG1 heavy chain domain of any of A1-A28 (H1-H28). In another embodiment, an antigen binding protein of the present disclosure comprises the kappa light chain constant chain region of A1-A28 (L1-L28), or a fragment of the kappa light chain constant region of A1-A28 (L1-L28). In another embodiment, an antigen binding protein of the present disclosure comprises both the IgG1 heavy chain domain, or a fragment thereof, of A1-A28 (L1-L28) and the kappa light chain domain, or a fragment thereof, of A1-A28 (L1-L28).

Accordingly, the antigen binding proteins of the present disclosure include those comprising, for example, the variable domain combinations L1H1, L2H2, L3H3, L4H4, L5H5, L6H6, L7H7, L8H8, L9H9, L10H10, L11H11, L12H12, L13H13, . . . and L28H28, having a desired isotype (for example, IgA, IgG1, IgG2, IgG3, IgG4, IgM, IgE, and IgD) as well as Fab or F(ab')$_2$ fragments thereof. Moreover, if an IgG4 is desired, it may also be desired to introduce a point mutation (CPSCP (SEQ ID NO: 11969)→CPPCP (SEQ ID NO: 11970)) in the hinge region as described in Bloom et al., 1997, *Protein Science* 6:407, incorporated by reference herein) to alleviate a tendency to form intra-H chain disulfide bonds that can lead to heterogeneity in the IgG4 antibodies.

In one embodiment, the antigen binding protein has a $K_{off}$ of $1 \times 10^4$ s$^{-1}$ or lower. In another embodiment, the $K_{off}$ is $5 \times 10^{-5}$ s$^{-1}$ or lower. In another embodiment, the $K_{off}$ is substantially the same as an antibody having a combination of light chain and heavy chain variable domain sequences selected from the group of combinations consisting of L1H1, L2H2, L3H3, L4H4, L5H5, L6H6, . . . and L28H28. In another embodiment, the antigen binding protein binds to CTLA-4 with substantially the same $K_{off}$ as an antibody that comprises one or more CDRs from an antibody having a combination of light chain and heavy chain variable domain sequences selected from the group of combinations consisting of L1H1, L2H2, L3H3, L4H4, L5H5, L6H6, . . . and L23H28. In another embodiment, the antigen binding protein binds to CTLA-4 with substantially the same $K_{off}$ as an antibody that comprises one of the amino acid sequences illustrated above. In another embodiment, the antigen binding protein binds to CTLA-4 with substantially the same $K_{off}$ as an antibody that comprises one or more CDRs from an antibody that comprises one of the amino acid sequences illustrated above.

In one aspect, the present disclosure provides antigen-binding fragments of an anti-CTLA-4 antibody of the present disclosure. Such fragments can consist entirely of antibody-derived sequences or can comprise additional sequences. Examples of antigen-binding fragments include Fab, F(ab')$_2$, single chain antibodies, diabodies, triabodies, tetrabodies, and domain antibodies. Other examples are provided in Lunde et al., 2002, Biochem. Soc. Trans. 30:500-06.

Single chain antibodies (scFv) may be formed by linking heavy and light chain variable domain (Fv region) fragments via an amino acid bridge (short peptide linker, e.g., a synthetic sequence of amino acid residues), resulting in a single polypeptide chain. Such single-chain Fvs (scFvs) have been prepared by fusing DNA encoding a peptide linker between DNAs encoding the two variable domain polypeptides ($V_L$ and $V_H$). The resulting polypeptides can fold back on themselves to form antigen-binding monomers, or they can form multimers (e.g., dimers, trimers, or tetramers), depending on the length of a flexible linker between the two variable domains (Kortt et al., 1997, *Prot. Eng.* 10:423; Kortt et al., 2001, *Biomol. Eng.* 18:95-108, Bird et al., 1988, *Science* 242:423-26 and Huston et al., 1988, *Proc. Natl.*

Acad. Sci. USA 85:5879-83). By combining different $V_L$ and $V_H$-comprising polypeptides, one can form multimeric scFvs that bind to different epitopes (Kriangkum et al., 2001, Biomol. Eng. 18:31-40). Techniques developed for the production of single chain antibodies include those described in U.S. Pat. No. 4,946,778; Bird, 1988, Science 242:423; Huston et al., 1988, Proc. Natl. Acad. Sci. USA 85:5879; Ward et al., 1989, Nature 334:544, de Graaf et al., 2002, Methods Mol Biol. 178:379-87. ScFvs comprising the variable domain combinations L1H1, L2H2, L3H3, L4H4, L5H5, L6H6, . . . , and L28H28 are encompassed by the present disclosure.

7.7. Monoclonal Antibody

In another aspect, the present disclosure provides monoclonal antibodies that bind to CTLA-4. Monoclonal antibodies of the present disclosure may be generated using a variety of known techniques. In general, monoclonal antibodies that bind to specific antigens may be obtained by methods known to those skilled in the art (see, for example, Kohler et al., Nature 256:495, 1975; Coligan et al. (eds.), Current Protocols in Immunology, 1:2.5.12.6.7 (John Wiley & Sons 1991); U.S. Pat. Nos. RE 32,011, 4,902,614, 4,543, 439, and 4,411,993; Monoclonal Antibodies, Hybridomas: A New Dimension in Biological Analyses, Plenum Press, Kennett, McKearn, and Bechtol (eds.) (1980); and Antibodies: A Laboratory Manual, Harlow and Lane (eds.), Cold Spring Harbor Laboratory Press (1988); Picksley et al., "Production of monoclonal antibodies against proteins expressed in E. coli," in DNA Cloning 2: Expression Systems, 2nd Edition, Glover et al. (eds.), page 93 (Oxford University Press 1995)). Antibody fragments may be derived therefrom using any suitable standard technique such as proteolytic digestion, or optionally, by proteolytic digestion (for example, using papain or pepsin) followed by mild reduction of disulfide bonds and alkylation. Alternatively, such fragments may also be generated by recombinant genetic engineering techniques as described herein.

Monoclonal antibodies can be obtained by injecting an animal, for example, a rat, hamster, a rabbit, or preferably a mouse, including for example a transgenic or a knock-out, as known in the art, with an immunogen comprising human CTLA-4 [sequence SEQ ID 7001] or a fragment thereof, according to methods known in the art and described herein. The presence of specific antibody production may be monitored after the initial injection and/or after a booster injection by obtaining a serum sample and detecting the presence of an antibody that binds to human CTLA-4 or peptide using any one of several immunodetection methods known in the art and described herein. From animals producing the desired antibodies, lymphoid cells, most commonly cells from the spleen or lymph node, are removed to obtain B-lymphocytes. The B lymphocytes are then fused with a drug-sensitized myeloma cell fusion partner, preferably one that is syngeneic with the immunized animal and that optionally has other desirable properties (e.g., inability to express endogenous Ig gene products, e.g., P3X63-Ag 8.653 (ATCC No. CRL 1580); NSO, SP20) to produce hybridomas, which are immortal eukaryotic cell lines.

The lymphoid (e.g., spleen) cells and the myeloma cells may be combined for a few minutes with a membrane fusion-promoting agent, such as polyethylene glycol or a nonionic detergent, and then plated at low density on a selective medium that supports the growth of hybridoma cells but not unfused myeloma cells. A preferred selection media is HAT (hypoxanthine, aminopterin, thymidine). After a sufficient time, usually about one to two weeks, colonies of cells are observed. Single colonies are isolated, and antibodies produced by the cells may be tested for binding activity to human CTLA-4, using any one of a variety of immunoassays known in the art and described herein. The hybridomas are cloned (e.g., by limited dilution cloning or by soft agar plaque isolation) and positive clones that produce an antibody specific to CTLA-4 are selected and cultured. The monoclonal antibodies from the hybridoma cultures may be isolated from the supernatants of hybridoma cultures.

An alternative method for production of a murine monoclonal antibody is to inject the hybridoma cells into the peritoneal cavity of a syngeneic mouse, for example, a mouse that has been treated (e.g., pristane-primed) to promote formation of ascites fluid containing the monoclonal antibody. Monoclonal antibodies can be isolated and purified by a variety of well-established techniques. Such isolation techniques include affinity chromatography with Protein-A Sepharose, size-exclusion chromatography, and ion-exchange chromatography (see, for example, Coligan at pages 2.7.1-2.7.12 and pages 2.9.1-2.9.3; Baines et al., "Purification of Immunoglobulin G (IgG)," in Methods in Molecular Biology, Vol. 10, pages 79-104 (The Humana Press, Inc. 1992)). Monoclonal antibodies may be purified by affinity chromatography using an appropriate ligand selected based on particular properties of the antibody (e.g., heavy or light chain isotype, binding specificity, etc.). Examples of a suitable ligand, immobilized on a solid support, include Protein A, Protein G, an anticonstant region (light chain or heavy chain) antibody, an anti-idiotype antibody, and a TGF-beta binding protein, or fragment or variant thereof.

Monoclonal antibodies may be produced using any technique known in the art, e.g., by immortalizing spleen cells harvested from the transgenic animal after completion of the immunization schedule. The spleen cells can be immortalized using any technique known in the art, e.g., by fusing them with myeloma cells to produce hybridomas. Hybridoma cell lines are identified that produce an antibody that binds a CTLA-4 polypeptide. Such hybridoma cell lines, and anti-CTLA-4 monoclonal antibodies produced by them, are encompassed by the present disclosure. Myeloma cells for use in hybridoma-producing fusion procedures preferably are non-antibody-producing, have high fusion efficiency, and enzyme deficiencies that render them incapable of growing in certain selective media which support the growth of only the desired fused cells (hybridomas). Examples of suitable cell lines for use in mouse fusions include Sp-20, P3-X63/Ag8, P3-X63-Ag8.653, NS1/1.Ag 41, Sp210-Ag14, FO, NSO/U, MPC-11, MPC11-X45-GTG 1.7 and S194/5XX0 Bul; examples of cell lines used in rat fusions include R210.RCY3, Y3-Ag 1.2.3, IR983F and 4B210. Other cell lines useful for cell fusions are U-266, GM1500-GRG2, LICR-LON-HMy2 and UC729-6. Hybridomas or mAbs may be further screened to identify mAbs with particular properties, such as the ability to block a CTLA-4-induced activity.

An antibody of the present disclosure may also be a fully human monoclonal antibody. An isolated fully human antibody is provided that specifically binds to the CTLA-4, wherein the antigen binding protein possesses at least one in vivo biological activity of a human anti-CTLA-4 antibody.

7.8. Method of Generating Antibodies

Fully human monoclonal antibodies may be generated by any number of techniques with which those having ordinary skill in the art will be familiar. Such methods include, but are not limited to, Epstein Barr Virus (EBV) transformation of human peripheral blood cells (e.g., containing B lymphocytes), in vitro immunization of human B-cells, fusion of spleen cells from immunized transgenic mice carrying inserted human immunoglobulin genes, isolation from human immunoglobulin V region phage libraries, or other procedures as known in the art and based on the disclosure herein. For example, fully human monoclonal antibodies may be obtained from transgenic mice that have been engineered to produce specific human antibodies in response to antigenic challenge. Methods for obtaining fully human antibodies from transgenic mice are described, for example, by Green et al., *Nature Genet.* 7:13, 1994; Lonberg et al., *Nature* 368:856, 1994; Taylor et al., *Int. Immun.* 6:579, 1994; U.S. Pat. No. 5,877,397; Bruggemann et al., 1997 *Curr. Opin. Biotechnol.* 8:455-58; Jakobovits et al., 1995 *Ann. N. Y. Acad. Sci.* 764:525-35. In this technique, elements of the human heavy and light chain locus are introduced into strains of mice derived from embryonic stem cell lines that contain targeted disruptions of the endogenous heavy chain and light chain loci (see also Bruggemann et al., *Curr. Opin. Biotechnol.* 8:455-58 (1997)). For example, human immunoglobulin transgenes may be mini-gene constructs, or transloci on yeast artificial chromosomes, which undergo B-cell-specific DNA rearrangement and hypermutation in the mouse lymphoid tissue. Fully human monoclonal antibodies may be obtained by immunizing the transgenic mice, which may then produce human antibodies specific for CTLA-4. Lymphoid cells of the immunized transgenic mice can be used to produce human antibody-secreting hybridomas according to the methods described herein. Polyclonal sera containing fully human antibodies may also be obtained from the blood of the immunized animals.

Another method for generating human antibodies of the present disclosure includes immortalizing human peripheral blood cells by EBV transformation. See, e.g., U.S. Pat. No. 4,464,456. Such an immortalized B-cell line (or lymphoblastoid cell line) producing a monoclonal antibody that specifically binds to CTLA-4 can be identified by immunodetection methods as provided herein, for example, an ELISA, and then isolated by standard cloning techniques. The stability of the lymphoblastoid cell line producing an anti-CTLA-4 antibody may be improved by fusing the transformed cell line with a murine myeloma to produce a mouse-human hybrid cell line according to methods known in the art (see, e.g., Glasky et al., *Hybridoma* 8:377-89 (1989)). Still another method to generate human monoclonal antibodies is in vitro immunization, which includes priming human splenic B-cells with human CTLA-4, followed by fusion of primed B-cells with a heterohybrid fusion partner. See, e.g., Boerner et al., 1991 *J. Immunol.* 147:86-95.

In certain embodiments, a B-cell that is producing an anti-human CTLA-4 antibody is selected and the light chain and heavy chain variable regions are cloned from the B-cell according to molecular biology techniques known in the art (WO 92/02551; U.S. Pat. No. 5,627,052; Babcook et al., *Proc. Natl. Acad. Sci.* USA 93:7843-48 (1996)) and described herein. B-cells from an immunized animal may be isolated from the spleen, lymph node, or peripheral blood sample by selecting a cell that is producing an antibody that specifically binds to CTLA-4. B-cells may also be isolated from humans, for example, from a peripheral blood sample.

Methods for detecting single B-cells that are producing an antibody with the desired specificity are well known in the art, for example, by plaque formation, fluorescence-activated cell sorting, in vitro stimulation followed by detection of specific antibody, and the like. Methods for selection of specific antibody-producing B-cells include, for example, preparing a single cell suspension of B-cells in soft agar that contains human CTLA-4. Binding of the specific antibody produced by the B-cell to the antigen results in the formation of a complex, which may be visible as an immunoprecipitate.

In some embodiments, specific antibody-producing B-cells are selected by using a method that allows identification natively paired antibodies. For example, a method described in Adler et al., A natively paired antibody library yields drug leads with higher sensitivity and specificity than a randomly paired antibody library, MAbs (2018), which is incorporated by reference in its entirety herein, can be employed. The method combines microfluidic technology, molecular genomics, yeast single-chain variable fragment (scFv) display, fluorescence-activated cell sorting (FACS) and deep sequencing as summarized in FIG. 1 adopted from Adler et al. In short, B cells can be isolated from immunized animals and then pooled. The B cells are encapsulated into droplets with oligo-dT beads and a lysis solution, and mRNA-bound beads are purified from the droplets, and then injected into a second emulsion with an OE-RT-PCR amplification mix that generates DNA amplicons that encode scFv with native pairing of heavy and light chain Ig. Libraries of natively paired amplicons are then electroporated into yeast for scFv display. FACS is used to identify high affinity scFv. Finally, deep antibody sequencing can be used to identify all clones in the pre- and post-sort scFv libraries.

After the B-cells producing the desired antibody are selected, the specific antibody genes may be cloned by isolating and amplifying DNA or mRNA according to methods known in the art and described herein.

The methods for obtaining antibodies of the present disclosure can also adopt various phage display technologies known in the art. See, e.g., Winter et al., 1994 *Annu. Rev. Immunol.* 12:433-55; Burton et al., 1994 *Adv. Immunol.* 57:191-280. Human or murine immunoglobulin variable region gene combinatorial libraries may be created in phage vectors that can be screened to select Ig fragments (Fab, Fv, sFv, or multimers thereof) that bind specifically to CTLA-4 binding protein or variant or fragment thereof. See, e.g., U.S. Pat. No. 5,223,409; Huse et al., 1989 *Science* 246:1275-81; Sastry et al., *Proc. Natl. Acad. Sci.* USA 86:5728-32 (1989); Alting-Mees et al., *Strategies in Molecular Biology* 3:1-9 (1990); Kang et al., 1991 *Proc. Natl. Acad. Sci.* USA 88:4363-66; Hoogenboom et al., 1992 *J. Molec. Biol.* 227: 381-388; Schlebusch et al., 1997 *Hybridoma* 16:47-52 and references cited therein. For example, a library containing a plurality of polynucleotide sequences encoding Ig variable region fragments may be inserted into the genome of a filamentous bacteriophage, such as M13 or a variant thereof, in frame with the sequence encoding a phage coat protein. A fusion protein may be a fusion of the coat protein with the light chain variable region domain and/or with the heavy chain variable region domain. According to certain embodiments, immunoglobulin Fab fragments may also be displayed on a phage particle (see, e.g., U.S. Pat. No. 5,698, 426).

Antibody fragments fused to another protein, such as a minor coat protein, can be also used to enrich phage with antigen. Then, using a random combinatorial library of rearranged heavy ($V_H$) and light ($V_L$) chains from mice immune to the antigen (e.g. CTLA-4), diverse libraries of antibody fragments are displayed on the surface of the phage. These libraries can be screened for complementary variable domains, and the domains purified by, for example, affinity column. See Clackson et al., Nature, V. 352 pp. 624-628 (1991).

Heavy and light chain immunoglobulin cDNA expression libraries may also be prepared in lambda phage, for example, using λImmunoZap™(H) and λImmunoZap™(L) vectors (Stratagene, La Jolla, California). Briefly, mRNA is isolated from a B-cell population, and used to create heavy and light chain immunoglobulin cDNA expression libraries in the λImmunoZap(H) and λImmunoZap(L) vectors. These vectors may be screened individually or co-expressed to form Fab fragments or antibodies (see Huse et al., supra; see also Sastry et al., supra). Positive plaques may subsequently be converted to a non-lytic plasmid that allows high level expression of monoclonal antibody fragments from E. coli.

In one embodiment, in a hybridoma the variable regions of a gene expressing a monoclonal antibody of interest are amplified using nucleotide primers. These primers may be synthesized by one of ordinary skill in the art, or may be purchased from commercially available sources. (See, e.g., Stratagene (La Jolla, California), which sells primers for mouse and human variable regions including, among others, primers for $V_{Ha}$, $V_{Hb}$, $V_{Hc}$, $V_{Hd}$, $C_{H1}$, $V_L$ and $C_L$ regions.) These primers may be used to amplify heavy or light chain variable regions, which may then be inserted into vectors such as ImmunoZAP™H or ImmunoZAP™L (Stratagene), respectively. These vectors may then be introduced into E. coli, yeast, or mammalian-based systems for expression. Large amounts of a single-chain protein containing a fusion of the $V_H$ and $V_L$ domains may be produced using these methods (see Bird et al., Science 242:423-426, 1988).

Once cells producing antibodies according to the disclosure have been obtained using any of the above-described immunization and other techniques, the specific antibody genes may be cloned by isolating and amplifying DNA or mRNA therefrom according to standard procedures as described herein. The antibodies produced therefrom may be sequenced and the CDRs identified and the DNA coding for the CDRs may be manipulated as described previously to generate other antibodies according to the disclosure.

CTLA-4 binding agents of the present disclosure preferably modulate CTLA-4 function in the cell-based assay described herein and/or the in vivo assay described herein and/or bind to one or more of the domains described herein and/or cross-block the binding of one of the antibodies described in this application and/or are cross-blocked from binding CTLA-4 by one of the antibodies described in this application. Accordingly such binding agents can be identified using the assays described herein.

In certain embodiments, antibodies are generated by first identifying antibodies that bind to one or more of the domains provided herein and/or neutralize in the cell-based and/or in vivo assays described herein and/or cross-block the antibodies described in this application and/or are cross-blocked from binding CTLA-4 by one of the antibodies described in this application. The CDR regions from these antibodies are then used to insert into appropriate biocompatible frameworks to generate CTLA-4 binding agents. The non-CDR portion of the binding agent may be composed of amino acids, or may be a non-protein molecule. The assays described herein allow the characterization of binding agents. Preferably the binding agents of the present disclosure are antibodies as defined herein.

Other antibodies according to the disclosure may be obtained by conventional immunization and cell fusion procedures as described herein and known in the art.

Molecular evolution of the complementarity determining regions (CDRs) in the center of the antibody binding site also has been used to isolate antibodies with increased affinity, for example, antibodies having increased affinity for c-erbB-2, as described by Schier et al., 1996, J. Mol. Biol. 263:551. Accordingly, such techniques are useful in preparing antibodies to CTLA-4. Antigen binding proteins directed against a CTLA-4 can be used, for example, in assays to detect the presence of CTLA-4 polypeptides, either in vitro or in vivo. The antigen binding proteins also may be employed in purifying CTLA-4 proteins by immunoaffinity chromatography.

Although human, partially human, or humanized antibodies will be suitable for many applications, particularly those involving administration of the antibody to a human subject, other types of antigen binding proteins will be suitable for certain applications. Non-human antibodies of the present disclosure can be, for example, derived from any antibody-producing animal, such as mouse, rat, rabbit, goat, donkey, or non-human primate (such as monkey (e.g., cynomolgus or rhesus monkey) or ape (e.g., chimpanzee)). An antibody from a particular species can be made by, for example, immunizing an animal of that species with the desired immunogen (e.g., a CTLA-4 polypeptide) or using an artificial system for generating antibodies of that species (e.g., a bacterial or phage display-based system for generating antibodies of a particular species), or by converting an antibody from one species into an antibody from another species by replacing, e.g., the constant region of the antibody with a constant region from the other species, or by replacing one or more amino acid residues of the antibody so that it more closely resembles the sequence of an antibody from the other species. In one embodiment, the antibody is a chimeric antibody comprising amino acid sequences derived from antibodies from two or more different species.

Antigen binding proteins may be prepared, and screened for desired properties, by any of a number of conventional techniques. Certain of the techniques involve isolating a nucleic acid encoding a polypeptide chain (or portion thereof) of an antigen binding protein of interest (e.g., an anti-CTLA-4 antibody), and manipulating the nucleic acid through recombinant DNA technology. The nucleic acid may be fused to another nucleic acid of interest, or altered (e.g., by mutagenesis or other conventional techniques) to add, delete, or substitute one or more amino acid residues, for example. Furthermore, the antigen binding proteins may be purified from cells that naturally express them (e.g., an antibody can be purified from a hybridoma that produces it), or produced in recombinant expression systems, using any technique known in the art. See, for example, Monoclonal Antibodies, Hybridomas: A New Dimension in Biological Analyses, Kennet et al. (eds.), Plenum Press, New York (1980); and Antibodies: A Laboratory Manual, Harlow and Land (eds.), Cold Spring Harbor Laboratory Press, Cold Spring Harbor, NY, (1988).

Any expression system known in the art can be used to make the recombinant polypeptides of the present disclosure. Expression systems are detailed comprehensively above. In general, host cells are transformed with a recombinant expression vector that comprises DNA encoding a desired polypeptide. Among the host cells that may be employed are prokaryotes, yeast or higher eukaryotic cells. Prokaryotes include gram negative or gram positive organisms, for example E. coli or Bacilli. Higher eukaryotic cells include insect cells and established cell lines of mammalian origin. Examples of suitable mammalian host cell lines include the COS-7 line of monkey kidney cells (ATCC CRL 1651) (Gluzman et al., 1981, Cell 23:175), L cells, 293 cells, C127 cells, 3T3 cells (ATCC CCL 163), Chinese hamster ovary (CHO) cells, HeLa cells, BHK (ATCC CRL 10) cell lines, and the CVI/EBNA cell line derived from the African green monkey kidney cell line CVI (ATCC CCL 70) as described by McMahan et al., 1991, EMBO J. 10: 2821. Appropriate cloning and expression vectors for use with bacterial, fungal, yeast, and mammalian cellular hosts are described by Pouwels et al. (*Cloning Vectors: A Laboratory Manual*, Elsevier, New York, 1985).

It will be appreciated that an antibody of the present disclosure may have at least one amino acid substitution, providing that the antibody retains binding specificity. Therefore, modifications to the antibody structures are encompassed within the scope of the present disclosure. These may include amino acid substitutions, which may be conservative or non-conservative that do not destroy the CTLA-4 binding capability of an antibody. Conservative amino acid substitutions may encompass non-naturally occurring amino acid residues, which are typically incorporated by chemical peptide synthesis rather than by synthesis in biological systems. These include peptidomimetics and other reversed or inverted forms of amino acid moieties. A conservative amino acid substitution may also involve a substitution of a native amino acid residue with a normative residue such that there is little or no effect on the polarity or charge of the amino acid residue at that position.

Non-conservative substitutions may involve the exchange of a member of one class of amino acids or amino acid mimetics for a member from another class with different physical properties (e.g. size, polarity, hydrophobicity, charge). Such substituted residues may be introduced into regions of the human antibody that are homologous with non-human antibodies, or into the non-homologous regions of the molecule.

Moreover, one skilled in the art may generate test variants containing a single amino acid substitution at each desired amino acid residue. The variants can then be screened using activity assays known to those skilled in the art. Such variants could be used to gather information about suitable variants. For example, if one discovered that a change to a particular amino acid residue resulted in destroyed, undesirably reduced, or unsuitable activity, variants with such a change may be avoided. In other words, based on information gathered from such routine experiments, one skilled in the art can readily determine the amino acids where further substitutions should be avoided either alone or in combination with other mutations.

A skilled artisan will be able to determine suitable variants of the polypeptide as set forth herein using well-known techniques. In certain embodiments, one skilled in the art may identify suitable areas of the molecule that may be changed without destroying activity by targeting regions not believed to be important for activity. In certain embodiments, one can identify residues and portions of the molecules that are conserved among similar polypeptides. In certain embodiments, even areas that may be important for biological activity or for structure may be subject to conservative amino acid substitutions without destroying the biological activity or without adversely affecting the polypeptide structure.

Additionally, one skilled in the art can review structure-function studies identifying residues in similar polypeptides that are important for activity or structure. In view of such a comparison, one can predict the importance of amino acid residues in a protein that correspond to amino acid residues which are important for activity or structure in similar proteins. One skilled in the art may opt for chemically similar amino acid substitutions for such predicted important amino acid residues.

One skilled in the art can also analyze the three-dimensional structure and amino acid sequence in relation to that structure in similar polypeptides. In view of such information, one skilled in the art may predict the alignment of amino acid residues of an antibody with respect to its three dimensional structure. In certain embodiments, one skilled in the art may choose not to make radical changes to amino acid residues predicted to be on the surface of the protein, since such residues may be involved in important interactions with other molecules.

A number of scientific publications have been devoted to the prediction of secondary structure. See Moult J., *Curr. Op. in Biotech.*, 7(4):422-427 (1996), Chou et al., *Biochem.*, 13(2):222-245 (1974); Chou et al., *Biochem.*, 113(2):211-222 (1974); Chou et al., *Adv. Enzymol. Relat. Areas Mol. Biol.*, 47:45-148 (1978); Chou et al., *Ann. Rev. Biochem.*, 47:251-276 and Chou et al., *Biophys. J.*, 26:367-384 (1979). Moreover, computer programs are currently available to assist with predicting secondary structure. One method of predicting secondary structure is based upon homology modeling. For example, two polypeptides or proteins which have a sequence identity of greater than 30%, or similarity greater than 40% often have similar structural topologies. The recent growth of the protein structural database (PDB) has provided enhanced predictability of secondary structure, including the potential number of folds within a polypeptide's or protein's structure. See Holm et al., *Nucl. Acid. Res.*, 27(1):244-247 (1999). It has been suggested (Brenner et al., *Curr. Op. Struct. Biol.*, 7(3):369-376 (1997)) that there are a limited number of folds in a given polypeptide or protein and that once a critical number of structures have been resolved, structural prediction will become dramatically more accurate.

Additional methods of predicting secondary structure include "threading" (Jones, D., *Curr. Opin. Struct. Biol.*, 7(3):377-87 (1997); Sippl et al., *Structure*, 4(1):15-19 (1996)), "profile analysis" (Bowie et al., *Science*, 253:164-170 (1991); Gribskov et al., *Meth. Enzym.*, 183:146-159 (1990); Gribskov et al., *Proc. Nat. Acad. Sci.*, 84(13):4355-4358 (1987)), and "evolutionary linkage" (See Holm, supra (1999), and Brenner, supra (1997)).

In certain embodiments, variants of antibodies include glycosylation variants wherein the number and/or type of glycosylation site has been altered compared to the amino acid sequences of a parent polypeptide. In certain embodiments, variants comprise a greater or a lesser number of N-linked glycosylation sites than the native protein. An N-linked glycosylation site is characterized by the sequence: Asn-X-Ser or Asn-X-Thr, wherein the amino acid residue designated as X can be any amino acid residue except proline. The substitution of amino acid residues to create this sequence provides a potential new site for the addition of an N-linked carbohydrate chain. Alternatively, substitutions which eliminate this sequence will remove an existing N-linked carbohydrate chain. Also provided is a rearrangement of N-linked carbohydrate chains wherein one or more N-linked glycosylation sites (typically those that are naturally occurring) are eliminated and one or more new N-linked sites are created. Additional preferred antibody variants include cysteine variants wherein one or more cysteine residues are deleted from or substituted for another amino acid (e.g., serine) as compared to the parent amino acid sequence. Cysteine variants can be useful when antibodies must be refolded into a biologically active conformation such as after the isolation of insoluble inclusion bodies. Cysteine variants generally have fewer cysteine residues than the native protein, and typically have an even number to minimize interactions resulting from unpaired cysteines.

Desired amino acid substitutions (whether conservative or non-conservative) can be determined by those skilled in the art at the time such substitutions are desired. In certain embodiments, amino acid substitutions can be used to identify important residues of antibodies to CTLA-4, or to increase or decrease the affinity of the antibodies to CTLA-4 described herein.

According to certain embodiments, preferred amino acid substitutions are those which: (1) reduce susceptibility to proteolysis, (2) reduce susceptibility to oxidation, (3) alter binding affinity for forming protein complexes, (4) alter binding affinities, and/or (4) confer or modify other physiochemical or functional properties on such polypeptides. According to certain embodiments, single or multiple amino acid substitutions (in certain embodiments, conservative amino acid substitutions) may be made in the naturally-occurring sequence (in certain embodiments, in the portion of the polypeptide outside the domain(s) forming intermolecular contacts). In certain embodiments, a conservative amino acid substitution typically may not substantially change the structural characteristics of the parent sequence (e.g., a replacement amino acid should not tend to break a helix that occurs in the parent sequence, or disrupt other types of secondary structure that characterizes the parent sequence). Examples of art-recognized polypeptide secondary and tertiary structures are described in Proteins, Structures and Molecular Principles (Creighton, Ed., W. H. Freeman and Company, New York (1984)); Introduction to Protein Structure (C. Branden and J. Tooze, eds., Garland Publishing, New York, N.Y. (1991)); and Thornton et al. *Nature* 354:105 (1991), which are each incorporated herein by reference.

In certain embodiments, antibodies of the present disclosure may be chemically bonded with polymers, lipids, or other moieties.

The binding agents may comprise at least one of the CDRs described herein incorporated into a biocompatible framework structure. In one example, the biocompatible framework structure comprises a polypeptide or portion thereof that is sufficient to form a conformationally stable structural support, or framework, or scaffold, which is able to display one or more sequences of amino acids that bind to an antigen (e.g., CDRs, a variable region, etc.) in a localized surface region. Such structures can be a naturally occurring polypeptide or polypeptide "fold" (a structural motif), or can have one or more modifications, such as additions, deletions or substitutions of amino acids, relative to a naturally occurring polypeptide or fold. These scaffolds can be derived from a polypeptide of any species (or of more than one species), such as a human, other mammal, other vertebrate, invertebrate, plant, bacteria or virus.

Typically the biocompatible framework structures are based on protein scaffolds or skeletons other than immunoglobulin domains. For example, those based on fibronectin, ankyrin, lipocalin, neocarzinostain, cytochrome b, CP1 zinc finger, PST1, coiled coil, LACI-D1, Z domain and tendamistat domains may be used (See e.g., Nygren and Uhlen, 1997, *Curr. Opin. in Struct. Biol.*, 7, 463-469).

Humanized antibodies can be produced using techniques known to those skilled in the art (Zhang, W., et al., *Molecular Immunology*. 42(12):1445-1451, 2005; Hwang W. et al., *Methods*. 36(1):35-42, 2005; Dall'Acqua W F, et al., *Methods* 36(1):43-60, 2005; and Clark, M., *Immunology Today*. 21(8):397-402, 2000).

Additionally, one skilled in the art will recognize that suitable binding agents include portions of these antibodies, such as one or more of CDR1-L1 to 28 with SEQ ID NOS 1001-1028; CDR2-L1 to 28 with SEQ ID NOS 2001-2028; CDR3-L1 to 28 with SEQ ID NOS 3001-3028; CDR1-H1 to 28 with SEQ ID NOS 4001-4028; CDR2-H1 to 28 with SEQ ID NOS 5001-5028; and CDR3-H1 to 28 with SEQ ID NOS 6001-6028, as specifically disclosed herein. At least one of the regions of CDR regions may have at least one amino acid substitution from the sequences provided here, provided that the antibody retains the binding specificity of the non-substituted CDR. The non-CDR portion of the antibody may be a non-protein molecule, wherein the binding agent cross-blocks the binding of an antibody disclosed herein to CTLA-4 and/or neutralizes CTLA-4. The non-CDR portion of the antibody may be a non-protein molecule in which the antibody exhibits a similar binding pattern to human CTLA-4 peptides in a competition binding assay as that exhibited by at least one of antibodies A1-A28, and/or neutralizes CTLA-4. The non-CDR portion of the antibody may be composed of amino acids, wherein the antibody is a recombinant binding protein or a synthetic peptide, and the recombinant binding protein cross-blocks the binding of an antibody disclosed herein to CTLA-4 and/or neutralizes CTLA-4. The non-CDR portion of the antibody may be composed of amino acids, wherein the antibody is a recombinant antibody, and the recombinant antibody exhibits a similar binding pattern to human CTLA-4 peptides in the human CTLA-4 peptide epitope competition binding assay (described hereinbelow) as that exhibited by at least one of the antibodies A1-A28, and/or neutralizes CTLA-4.

Where an antibody comprises one or more of CDR1-H, CDR2-H, CDR3-H, CDR1-L, CDR2-L and CDR3-L as described above, it may be obtained by expression from a host cell containing DNA coding for these sequences. A DNA coding for each CDR sequence may be determined on the basis of the amino acid sequence of the CDR and synthesized together with any desired antibody variable region framework and constant region DNA sequences using oligonucleotide synthesis techniques, site-directed mutagenesis and polymerase chain reaction (PCR) techniques as appropriate. DNA coding for variable region frameworks and constant regions is widely available to those skilled in the art from genetic sequences databases such as GenBank®.

Once synthesized, the DNA encoding an antibody of the present disclosure or fragment thereof may be propagated and expressed according to any of a variety of well-known procedures for nucleic acid excision, ligation, transformation, and transfection using any number of known expression vectors. Thus, in certain embodiments expression of an antibody fragment may be preferred in a prokaryotic host, such as *Escherichia coli* (see, e.g., Pluckthun et al., 1989 *Methods Enzymol*. 178:497-515). In certain other embodiments, expression of the antibody or a fragment thereof may be preferred in a eukaryotic host cell, including yeast (e.g., *Saccharomyces cerevisiae, Schizosaccharomyces pombe*, and *Pichiapastoris*), animal cells (including mammalian cells) or plant cells. Examples of suitable animal cells include, but are not limited to, myeloma (such as a mouse NSO line), COS, CHO, or hybridoma cells. Examples of plant cells include tobacco, corn, soybean, and rice cells.

One or more replicable expression vectors containing DNA encoding an antibody variable and/or constant region may be prepared and used to transform an appropriate cell line, for example, a non-producing myeloma cell line, such as a mouse NSO line or a bacteria, such as *E. coli*, in which production of the antibody will occur. In order to obtain efficient transcription and translation, the DNA sequence in each vector should include appropriate regulatory sequences, particularly a promoter and leader sequence operatively linked to the variable domain sequence. Particular methods for producing antibodies in this way are generally well-known and routinely used. For example, basic molecular biology procedures are described by Maniatis et al. (*Molecular Cloning, A Laboratory Manual,* 2nd ed., Cold Spring Harbor Laboratory, New York, 1989; see also Maniatis et al, 3rd ed., Cold Spring Harbor Laboratory, New York, (2001)). DNA sequencing can be performed as described in Sanger et al. (PNAS 74:5463, (1977)) and the Amersham International plc sequencing handbook, and site directed mutagenesis can be carried out according to methods known in the art (Kramer et al., *Nucleic Acids Res.* 12:9441, (1984); Kunkel *Proc. Natl. Acad. Sci.* USA 82:488-92 (1985); Kunkel et al., *Methods in Enzymol.* 154:367-82 (1987); the Anglian Biotechnology Ltd. handbook). Additionally, numerous publications describe techniques suitable for the preparation of antibodies by manipulation of DNA, creation of expression vectors, and transformation and culture of appropriate cells (Mountain A and Adair, J R in *Biotechnology and Genetic Engineering Reviews* (ed. Tombs, M P, 10, Chapter 1, 1992, Intercept, Andover, UK); "Current Protocols in Molecular Biology", 1999, F. M. Ausubel (ed.), Wiley Interscience, New York).

Where it is desired to improve the affinity of antibodies according to the disclosure containing one or more of the above-mentioned CDRs can be obtained by a number of affinity maturation protocols including maintaining the CDRs (Yang et al., *J. Mol. Biol.,* 254, 392-403, 1995), chain shuffling (Marks et al., *Bio/Technology,* 10, 779-783, 1992), use of mutation strains of *E. coli.* (Low et al., *J. Mol. Biol.,* 250, 350-368, 1996), DNA shuffling (Patten et al., *Curr. Opin. Biotechnol.,* 8, 724-733, 1997), phage display (Thompson et al., *J. Mol. Biol.,* 256, 7-88, 1996) and sexual PCR (Crameri, et al., *Nature,* 391, 288-291, 1998). All of these methods of affinity maturation are discussed by Vaughan et al. (*Nature Biotech.,* 16, 535-539, 1998).

It will be understood by one skilled in the art that some proteins, such as antibodies, may undergo a variety of posttranslational modifications. The type and extent of these modifications often depends on the host cell line used to express the protein as well as the culture conditions. Such modifications may include variations in glycosylation, methionine oxidation, diketopiperizine formation, aspartate isomerization and asparagine deamidation. A frequent modification is the loss of a carboxy-terminal basic residue (such as lysine or arginine) due to the action of carboxypeptidases (as described in Harris, R. J. Journal of Chromatography 705:129-134, 1995).

7.9. Sequences

Antibodies A1-A28 comprise heavy and light chain V(J)D polynucleotides (also referred to herein as L1-L28 and H1-H28, respectively). Antibodies A1-A28 comprise the sequences listed in TABLE 5. For example, antibody A1 comprises light chain L1 (SEQ ID NO:1) and heavy chain H1 (SEQ TD NO:101). CDR sequences in the light chain (L1-L28) and heavy chain (H1-H28) are also provided with a specific SEQ TD NOs. For example, three CDR sequences (CDR1, CDR 2 and CDR3) for L1 are CDR1-L1 (SEQ TD NO:1001), CDR2-L1 (SEQ ID NO:2001) and CDR3-L1 (SEQ ID NO:3001), respectively and three CDR sequences (CDR1, CDR 2 and CDR3) for H1 are CDR1-H1 (SEQ ID NO4001), CDR2-H1 (SEQ ID NO:5001) and CDR3-H1 (SEQ TD NO:6001).

TABLE 5

| Antibodies | Light Chain | Heavy Chain |
| --- | --- | --- |
| A1 | L1 (SEQ ID NO: 1)<br>L1 comprises CDR1-L1 (SEQ ID NO: 1001),<br>L1 (SEQ ID NO: 2001) and CDR3-LI (SEQ ID NO: 3001) | H1 (SEQ ID NO: 101)<br>CDR2-H1 comprises CDR1-H1 (SEQ ID NO: 4001), CDR2-H1 (SEQ ID NO: 5001) and CDR3-H1 (SEQ ID NO: 6001) |
| A2 | L2 (SEQ ID NO: 2)<br>L2 comprises CDR1-L2 (SEQ ID NO: 1002),<br>L2 (SEQ ID NO: 2002) and CDR3-L2 (SEQ ID NO: 3002) | H2 (SEQ ID NO: 102)<br>CDR2-He comprises CDR1-H2 (SEQ ID NO: 4002), CDR2-H2 (SEQ ID NO: 5002) and CDR3-H2 (SEQ ID NO: 6002) |
| A3 | L3 (SEQ ID NO: 3)<br>L3 comprises CDR1-L3 (SEQ ID NO: 1003),<br>L3 (SEQ ID NO: 2003) and CDR3-L3 (SEQ ID NO: 3003) | H3 (SEQ ID NO: 103)<br>CDR2-H3 comprises CDR1-H3 (SEQ ID NO: 4003), CDR2-H3 (SEQ ID NO: 5003) and CDR3-H3 (SEQ ID NO: 6003) |
| A4 | L4 (SEQ ID NO: 4)<br>L4 comprises CDR1-L4 (SEQ ID NO: 1004),<br>L4 (SEQ ID NO: 2004) and CDR3-L4 (SEQ ID NO: 3004) | H4 (SEQ ID NO: 104)<br>CDR2-H4 comprises CDR1-H4 (SEQ ID NO: 4004), CDR2-H4 (SEQ ID NO: 5004) and CDR3-H4 (SEQ ID NO: 6004) |
| A5 | L5 (SEQ ID NO: 5)<br>L5 comprises CDR1-L5 (SEQ ID NO: 1005),<br>L5 (SEQ ID NO: 2005) and CDR3-L5 (SEQ ID NO: 3005) | H5 (SEQ ID NO: 105)<br>CDR2-H4 comprises CDR1-H5 (SEQ ID NO: 4005), CDR2-H5 (SEQ ID NO: 5005) and CDR3-H5 (SEQ ID NO: 6005) |
| A6 | L6 (SEQ ID NO: 6)<br>L6 comprises CDR1-L6 (SEQ ID NO: 1006),<br>L6 (SEQ ID NO: 2006) and CDR3-L6 (SEQ ID NO: 3006) | H6 (SEQ ID NO: 106)<br>CDR2-H6 comprises CDR1-H6 (SEQ ID NO: 4006), CDR2-H6 (SEQ ID NO: 5006) and CDR3-H6 (SEQ ID NO: 6006) |

TABLE 5-continued

| Antibodies | Light Chain | Heavy Chain |
|---|---|---|
| A7 | L7 (SEQ ID NO: 7)<br>L7 comprises CDR1-L7 (SEQ ID NO: 1007), CDR2-L7 (SEQ ID NO: 2007) and CDR3-L7 (SEQ ID NO: 3007) | H7 (SEQ ID NO: 107)<br>H7 comprises CDR1-H7 (SEQ ID NO: 4007), CDR2-H7 (SEQ ID NO: 5007) and CDR3-H7 (SEQ ID NO: 6007) |
| A8 | L8 (SEQ ID NO: 8)<br>L8 comprises CDR1-L8 (SEQ ID NO: 1008), CDR2-L8 (SEQ ID NO: 2008) and CDR3-L6 (SEQ ID NO: 3008) | H8 (SEQ ID NO: 108)<br>H8 comprises CDR1-H8 (SEQ ID NO: 4008), CDR2-H8 (SEQ ID NO: 5008) and CDR3-H8 (SEQ ID NO: 6008) |
| A9 | L9 (SEQ ID NO: 9)<br>L9 comprises CDR1-L9 (SEQ ID NO: 1009), CDR2-L9 (SEQ ID NO: 2009) and CDR3-L9 (SEQ ID NO: 3009) | H9 (SEQ ID NO: 109)<br>H9 comprises CDR1-H9 (SEQ ID NO: 4009), CDR2-H9 (SEQ ID NO: 5009) and CDR3-H9 (SEQ ID NO: 6009) |
| A10 | L10 (SEQ ID NO: 10)<br>L10 comprises CDR1-L10 (SEQ ID NO: 1010), CDR2-L10 (SEQ ID NO: 2010) and CDR3-L10 (SEQ ID NO: 3010) | H10 (SEQ ID NO: 110)<br>H10 comprises CDR1-H10 (SEQ ID NO: 4010), CDR2-H10 (SEQ ID NO: 5010) and CDR3-H10 (SEQ ID NO: 6010) |
| A11 | L11 (SEQ ID NO: 11)<br>L11 comprises CDR1-L11 (SEQ ID NO: 1011), CDR2-L11 (SEQ ID NO: 2011) and CDR3-L11 (SEQ ID NO: 3011) | H11 (SEQ ID NO: 111)<br>H11 comprises CDR1-H11 (SEQ ID NO: 4011), CDR2-H11 (SEQ ID NO: 5011) and CDR3-H11 (SEQ ID NO: 6011) |
| A12 | L12 (SEQ ID NO: 12)<br>L12 comprises CDR1-L12 (SEQ ID NO: 1012), CDR2-L12 (SEQ ID NO: 2012) and CDR3-L12 (SEQ ID NO: 3012) | H12 (SEQ ID NO: 112)<br>H12 comprises CDR1-H12 (SEQ ID NO: 4012), CDR2-H12 (SEQ ID NO: 5012) and CDR3-H12 (SEQ ID NO: 6012) |
| A13 | L13 (SEQ ID NO: 13)<br>L13 comprises CDR1-L13 (SEQ ID NO: 1013), CDR2-L13 (SEQ ID NO: 2013) and CDR3-L13 (SEQ ID NO: 3013) | H13 (SEQ ID NO: 113)<br>H13 comprises CDR1-H13 (SEQ ID NO: 4013), CDR2-H13 (SEQ ID NO: 5013) and CDR3-H13 (SEQ ID NO: 6013) |
| A14 | L14 (SEQ ID NO: 14)<br>L14 comprises CDR1-L14 (SEQ ID NO: 1014), CDR2-L14 (SEQ ID NO: 2014) and CDR3-L14 (SEQ ID NO: 3014) | H14 (SEQ ID NO: 114)<br>H14 comprises CDR1-H14 (SEQ ID NO: 4014), CDR2-H14 (SEQ ID NO: 5014) and CDR3-H14 (SEQ ID NO: 6014) |
| A15 | L15 (SEQ ID NO: 15)<br>L15 comprises CDR1-L15 (SEQ ID NO: 1015), CDR2-L15 (SEQ ID NO: 2015) and CDR3-L15 (SEQ ID NO: 3015) | H15 (SEQ ID NO: 115)<br>H15 comprises CDR1-H15 (SEQ ID NO: 4015), CDR2-H15 (SEQ ID NO: 5015) and CDR3-H15 (SEQ ID NO: 6015) |
| A16 | L16 (SEQ ID NO: 16)<br>L16 comprises CDR1-L16 (SEQ ID NO: 1016), CDR2-L16 (SEQ ID NO: 2016) and CDR3-L16 (SEQ ID NO: 3016) | H16 (SEQ ID NO: 116)<br>H16 comprises CDR1-H16 (SEQ ID NO: 4016), CDR2-H16 (SEQ ID NO: 5016) and CDR3-H16 (SEQ ID NO: 6016) |
| A17 | L17 (SEQ ID NO: 17)<br>L17 comprises CDR1-L17 (SEQ ID NO: 1017), CDR2-L17 (SEQ ID NO: 2017) and CDR3-L17 (SEQ ID NO: 3017) | H17 (SEQ ID NO: 117)<br>H17 comprises CDR1-H17 (SEQ ID NO: 4017), CDR2-H17 (SEQ ID NO: 5017) and CDR3-H17 (SEQ ID NO: 6017) |
| A18 | L18 (SEQ ID NO: 18)<br>L18 comprises CDR1-L18 (SEQ ID NO: 1018), CDR2-L18 (SEQ ID NO: 2018) and CDR3-L18 (SEQ ID NO: 3018) | H18 (SEQ ID NO: 118)<br>H18 comprises CDR1-H18 (SEQ ID NO: 4018), CDR2-H18 (SEQ ID NO: 5018) and CDR3-H18 (SEQ ID NO: 6018) |
| A19 | L19 (SEQ ID NO: 19)<br>L19 comprises CDR1-L19 (SEQ ID NO: 1019), CDR2-L19 (SEQ ID NO: 2019) and CDR3-L19 (SEQ ID NO: 3019) | H19 (SEQ ID NO: 119)<br>H19 comprises CDR1-H19 (SEQ ID NO: 4019), CDR2-H19 (SEQ ID NO: 5019) and CDR3-H19 (SEQ ID NO: 6019) |

TABLE 5-continued

| Antibodies | Light Chain | Heavy Chain |
|---|---|---|
| A20 | L20 (SEQ ID NO: 20)<br>L20 comprises CDR1-L20 (SEQ ID NO: 1020), CDR2-L20 (SEQ ID NO: 2020) and CDR3-L20 (SEQ ID NO: 3020) | H20 (SEQ ID NO: 120)<br>H20 comprises CDR1-H20 (SEQ ID NO: 4020), CDR2-H20 (SEQ ID NO: 5020) and CDR3-H20 (SEQ ID NO: 6020) |
| A21 | L21 (SEQ ID NO: 21)<br>L21 comprises CDR1-L21 (SEQ ID NO: 1021), CDR2-L21 (SEQ ID NO: 2021) and CDR3-L21 (SEQ ID NO: 3021) | H21 (SEQ ID NO: 121)<br>H21 comprises CDR1-H21 (SEQ ID NO: 4021), CDR2-H21 (SEQ ID NO: 5021) and CDR3-H21 (SEQ ID NO: 6021) |
| A22 | L22 (SEQ ID NO: 22)<br>L22 comprises CDR1-L22 (SEQ ID NO: 1022), CDR2-L22 (SEQ ID NO: 2022) and CDR3-L22 (SEQ ID NO: 3022) | H22 (SEQ ID NO: 122)<br>H22 comprises CDR1-H22 (SEQ ID NO: 4022), CDR2-H22 (SEQ ID NO: 5022) and CDR3-H22 (SEQ ID NO: 6022) |
| A23 | L23 (SEQ ID NO: 23)<br>L23 comprises CDR1-L23 (SEQ ID NO: 1023), CDR2-L23 (SEQ ID NO: 2023) and CDR3-L23 (SEQ ID NO: 3023) | H23 (SEQ ID NO: 123)<br>H23 comprises CDR1-H23 (SEQ ID NO: 4023), CDR2-H23 (SEQ ID NO: 5023) and CDR3-H23 (SEQ ID NO: 6023) |
| A24 | L24 (SEQ ID NO: 24)<br>L24 comprises CDR1-L24 (SEQ ID NO: 1024), CDR2-L24 (SEQ ID NO: 2024) and CDR3-L24 (SEQ ID NO: 3024) | H24 (SEQ ID NO: 124)<br>H24 comprises CDR1-H24 (SEQ ID NO: 4024), CDR2-H24 (SEQ ID NO: 5024) and CDR3-H24 (SEQ ID NO: 6024) |
| A25 | L25 (SEQ ID NO: 25)<br>L25 comprises CDR1-L25 (SEQ ID NO: 1025), CDR2-L25 (SEQ ID NO: 2025) and CDR3-L25 (SEQ ID NO: 3025) | H25 (SEQ ID NO: 125)<br>H25 comprises CDR1-H25 (SEQ ID NO: 4025), CDR2-H25 (SEQ ID NO: 5025) and CDR3-H25 (SEQ ID NO: 6025) |
| A26 | L26 (SEQ ID NO: 26)<br>L26 comprises CDR1-L26 (SEQ ID NO: 1026), CDR2-L26 (SEQ ID NO: 2026) and CDR3-L26 (SEQ ID NO: 3026) | H26 (SEQ ID NO: 126)<br>H26 comprises CDR1-H26 (SEQ ID NO: 4026), CDR2-H26 (SEQ ID NO: 5026) and CDR3-H26 (SEQ ID NO: 6026) |
| A27 | L27 (SEQ ID NO: 27)<br>L27 comprises CDR1-L27 (SEQ ID NO: 1027), CDR2-L27 (SEQ ID NO: 2027) and CDR3-L27 (SEQ ID NO: 3027) | H27 (SEQ ID NO: 127)<br>H27 comprises CDR1-H27 (SEQ ID NO: 4027), CDR2-H27 (SEQ ID NO: 5027) and CDR3-H27 (SEQ ID NO: 6027) |
| A28 | L28 (SEQ ID NO: 28)<br>L28 comprises CDR1-L28 (SEQ ID NO: 1028), CDR2-L28 (SEQ ID NO: 2028) and CDR3-L28 (SEQ ID NO: 3028) | H28 (SEQ ID NO: 128)<br>H28 comprises CDR1-H28 (SEQ ID NO: 4028), CDR2-H28 (SEQ ID NO: 5028) and CDR3-H28 (SEQ ID NO: 6028) |

7.10. Pharmaceutical Compositions

Pharmaceutical compositions containing the proteins and polypeptides of the present disclosure are also provided. Such compositions comprise a therapeutically or prophylactically effective amount of the polypeptide or protein in a mixture with pharmaceutically acceptable materials, and physiologically acceptable formulation materials.

The pharmaceutical composition may contain formulation materials for modifying, maintaining or preserving, for example, the pH, osmolarity, viscosity, clarity, color, isotonicity, odor, sterility, stability, rate of dissolution or release, adsorption or penetration of the composition.

Suitable formulation materials include, but are not limited to, amino acids (such as glycine, glutamine, asparagine, arginine or lysine); antimicrobials; antioxidants (such as ascorbic acid, sodium sulfite or sodium hydrogen-sulfite); buffers (such as borate, bicarbonate, Tris-HCl, citrates, phosphates, other organic acids); bulking agents (such as mannitol or glycine), chelating agents (such as ethylenediamine tetraacetic acid (EDTA)); complexing agents (such as caffeine, polyvinylpyrrolidone, beta-cyclodextrin or hydroxypropyl-beta-cyclodextrin); fillers; monosaccharides; disaccharides and other carbohydrates (such as glucose, mannose, or dextrins); proteins (such as serum albumin, gelatin or immunoglobulins); coloring; flavoring and diluting agents; emulsifying agents; hydrophilic polymers (such as polyvinylpyrrolidone); low molecular weight polypeptides; salt-forming counterions (such as sodium); preservatives (such as benzalkonium chloride, benzoic acid, salicylic acid, thimerosal, phenethyl alcohol, methylparaben, propylparaben, chlorhexidine, sorbic acid or hydrogen peroxide); solvents (such as glycerin, propylene glycol or polyethylene glycol); sugar alcohols (such as mannitol or sorbitol); suspending agents; surfactants or wetting agents (such as pluronics, PEG, sorbitan esters, polysorbates such as polysorbate 20, polysorbate 80, triton, tromethamine, lecithin, cholesterol, tyloxapal); stability enhancing agents (sucrose or sorbitol); tonicity enhancing agents (such as alkali metal halides (preferably sodium or potassium chloride, mannitol sorbitol); delivery vehicles; diluents; excipients and/or pharmaceutical adjuvants. Neutral buffered saline or saline mixed with conspecific serum albumin are examples of appropriate diluents. In accordance with appropriate industry standards, preservatives such as benzyl alcohol may also be added. The composition may be formulated as a lyophilizate using appropriate excipient solutions (e.g., sucrose) as diluents. Suitable components are nontoxic to recipients at the dosages and concentrations employed. Further examples of components that may be employed in pharmaceutical formulations are presented in Remington's Pharmaceutical Sciences, 16$^{th}$ Ed. (1980) and 20$^{th}$ Ed. (2000), Mack Publishing Company, Easton, PA.

Optionally, the composition additionally comprises one or more physiologically active agents, for example, an anti-angiogenic substance, a chemotherapeutic substance (such as capecitabine, 5-fluorouracil, or doxorubicin), an analgesic substance, etc., non-exclusive examples of which are provided herein. In various particular embodiments, the composition comprises one, two, three, four, five, or six physiologically active agents in addition to a CTLA-4-binding protein.

In another embodiment of the present disclosure, the compositions disclosed herein may be formulated in a neutral or salt form. Illustrative pharmaceutically-acceptable salts include the acid addition salts (formed with the free amino groups of the protein) and which are formed with inorganic acids such as, for example, hydrochloric or phosphoric acids, or such organic acids as acetic, oxalic, tartaric, mandelic, and the like. Salts formed with the free carboxyl groups can also be derived from inorganic bases such as, for example, sodium, potassium, ammonium, calcium, or ferric hydroxides, and such organic bases as isopropylamine, trimethylamine, histidine, procaine and the like. Upon formulation, solutions will be administered in a manner compatible with the dosage formulation and in such amount as is therapeutically effective.

The carriers can further comprise any and all solvents, dispersion media, vehicles, coatings, diluents, antibacterial and antifungal agents, isotonic and absorption delaying agents, buffers, carrier solutions, suspensions, colloids, and the like. The use of such media and agents for pharmaceutical active substances is well known in the art. Except insofar as any conventional media or agent is incompatible with the active ingredient, its use in the therapeutic compositions is contemplated. Supplementary active ingredients can also be incorporated into the compositions. The phrase "pharmaceutically-acceptable" refers to molecular entities and compositions that do not produce an allergic or similar untoward reaction when administered to a human.

The optimal pharmaceutical composition will be determined by one skilled in the art depending upon, for example, the intended route of administration, delivery format, and desired dosage. See for example, Remington's Pharmaceutical Sciences, supra. Such compositions may influence the physical state, stability, rate of in vivo release, and rate of in vivo clearance of the polypeptide. For example, suitable compositions may be water for injection, physiological saline solution for parenteral administration.

7.10.1. Content of Pharmaceutically Active Ingredient

In typical embodiments, the active ingredient (i.e., the proteins and polypeptides of the present disclosure) is present in the pharmaceutical composition at a concentration of at least 0.1 mg/ml, at least 0.1 mg/ml, at least 0.5 mg/ml, or at least 1 mg/ml. In certain embodiments, the active ingredient is present in the pharmaceutical composition at a concentration of at least 1 mg/ml, 2 mg/ml, 3 mg/ml, 4 mg/ml, 5 mg/ml, 10 mg/ml, 15 mg/ml, 20 mg/ml, or 25 mg/ml. In certain embodiments, the active ingredient is present in the pharmaceutical composition at a concentration of at least 30 mg/ml, 35 mg/ml, 40 mg/ml, 45 mg/ml or 50 mg/ml.

In some embodiments, the pharmaceutical composition comprises one or more additional active ingredients in addition to the proteins or polypeptides of the present disclosure. The one or more additional active ingredients can be a drug targeting a different check point receptor, such as PD-1 inhibitor (e.g., anti-PD-1 antibody) or TIGIT inhibitor (e.g., anti-TIGIT antibody).

7.10.2. Formulation Generally

The pharmaceutical composition can be in any form appropriate for human or veterinary medicine, including a liquid, an oil, an emulsion, a gel, a colloid, an aerosol or a solid.

The pharmaceutical composition can be formulated for administration by any route of administration appropriate for human or veterinary medicine, including enteral and parenteral routes of administration.

In various embodiments, the pharmaceutical composition is formulated for administration by inhalation. In certain of these embodiments, the pharmaceutical composition is formulated for administration by a vaporizer. In certain of these embodiments, the pharmaceutical composition is formulated for administration by a nebulizer. In certain of these embodiments, the pharmaceutical composition is formulated for administration by an aerosolizer.

In various embodiments, the pharmaceutical composition is formulated for oral administration, for buccal administration, or for sublingual administration.

In some embodiments, the pharmaceutical composition is formulated for intravenous, intramuscular, or subcutaneous administration.

In some embodiments, the pharmaceutical composition is formulated for intrathecal or intracerebroventricular administration.

In some embodiments, the pharmaceutical composition is formulated for topical administration.

7.10.3. Pharmacological Compositions Adapted for Injection

For intravenous, cutaneous or subcutaneous injection, or injection at the site of affliction, the active ingredient will be in the form of a parenterally acceptable aqueous solution which is pyrogen-free and has suitable pH, isotonicity and stability. Those of relevant skill in the art are well able to prepare suitable solutions using, for example, isotonic vehicles such as Sodium Chloride Injection, Ringer's Injection, Lactated Ringer's Injection. Preservatives, stabilisers, buffers, antioxidants and/or other additives can be included, as required.

In various embodiments, the unit dosage form is a vial, ampule, bottle, or pre-filled syringe. In some embodiments, the unit dosage form contains 0.01 mg, 0.1 mg, 0.5 mg, 1 mg, 2.5 mg, 5 mg, 10 mg, 12.5 mg, 25 mg, 50 mg, 75 mg, or 100 mg of the pharmaceutical composition. In some embodiments, the unit dosage form contains 125 mg, 150 mg, 175 mg, or 200 mg of the pharmaceutical composition. In some embodiments, the unit dosage form contains 250 mg of the pharmaceutical composition.

In typical embodiments, the pharmaceutical composition in the unit dosage form is in liquid form. In various embodiments, the unit dosage form contains between 0.1 mL and 50 ml of the pharmaceutical composition. In some embodiments, the unit dosage form contains 1 ml, 2.5 ml, 5 ml, 7.5 ml, 10 ml, 25 ml, or 50 ml of pharmaceutical composition.

In particular embodiments, the unit dosage form is a vial containing 1 ml of the pharmaceutical composition at a concentration of 0.01 mg/ml, 0.1 mg/ml, 0.5 mg/ml, or 1 mg/ml. In some embodiments, the unit dosage form is a vial containing 2 ml of the pharmaceutical composition at a concentration of 0.01 mg/ml, 0.1 mg/ml, 0.5 mg/ml, or 1 mg/ml.

In some embodiments, the pharmaceutical composition in the unit dosage form is in solid form, such as a lyophilate, suitable for solubilization.

Unit dosage form embodiments suitable for subcutaneous, intradermal, or intramuscular administration include preloaded syringes, auto-injectors, and autoinject pens, each containing a predetermined amount of the pharmaceutical composition described hereinabove.

In various embodiments, the unit dosage form is a preloaded syringe, comprising a syringe and a predetermined amount of the pharmaceutical composition. In certain preloaded syringe embodiments, the syringe is adapted for subcutaneous administration. In certain embodiments, the syringe is suitable for self-administration. In particular embodiments, the preloaded syringe is a single use syringe.

In various embodiments, the preloaded syringe contains about 0.1 mL to about 0.5 mL of the pharmaceutical composition. In certain embodiments, the syringe contains about 0.5 mL of the pharmaceutical composition. In specific embodiments, the syringe contains about 1.0 mL of the pharmaceutical composition. In particular embodiments, the syringe contains about 2.0 mL of the pharmaceutical composition.

In certain embodiments, the unit dosage form is an autoinject pen. The autoinject pen comprises an autoinject pen containing a pharmaceutical composition as described herein. In some embodiments, the autoinject pen delivers a predetermined volume of pharmaceutical composition. In other embodiments, the autoinject pen is configured to deliver a volume of pharmaceutical composition set by the user.

In various embodiments, the autoinject pen contains about 0.1 mL to about 5.0 mL of the pharmaceutical composition. In specific embodiments, the autoinject pen contains about 0.5 mL of the pharmaceutical composition. In particular embodiments, the autoinject pen contains about 1.0 mL of the pharmaceutical composition. In other embodiments, the autoinject pen contains about 5.0 mL of the pharmaceutical composition.

7.11. Unit Dosage Forms

The pharmaceutical compositions may conveniently be presented in unit dosage form.

The unit dosage form will typically be adapted to one or more specific routes of administration of the pharmaceutical composition.

In various embodiments, the unit dosage form is adapted for administration by inhalation. In certain of these embodiments, the unit dosage form is adapted for administration by a vaporizer. In certain of these embodiments, the unit dosage form is adapted for administration by a nebulizer. In certain of these embodiments, the unit dosage form is adapted for administration by an aerosolizer.

In various embodiments, the unit dosage form is adapted for oral administration, for buccal administration, or for sublingual administration.

In some embodiments, the unit dosage form is adapted for intravenous, intramuscular, or subcutaneous administration.

In some embodiments, the unit dosage form is adapted for intrathecal or intracerebroventricular administration.

In some embodiments, the pharmaceutical composition is formulated for topical administration.

The amount of active ingredient which can be combined with a carrier material to produce a single dosage form will generally be that amount of the compound which produces a therapeutic effect.

7.12. Methods of Use

Therapeutic antibodies may be used that specifically bind to intact CTLA-4.

In vivo and/or in vitro assays may optionally be employed to help identify optimal dosage ranges. The precise dose to be employed in the formulation will also depend on the route of administration, and the seriousness of the condition, and should be decided according to the judgment of the practitioner and each subject's circumstances. Effective doses may be extrapolated from dose-response curves derived from in vitro or animal model test systems.

An oligopeptide or polypeptide is within the scope of the present disclosure if it has an amino acid sequence that is at least 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identical to least one of the CDRs provided herein; and/or to a CDR of a CTLA-4 binding agent that cross-blocks the binding of at least one of antibodies A1-A28 to CTLA-4, and/or is cross-blocked from binding to CTLA-4 by at least one of antibodies A1-A28; and/or to a CDR of a CTLA-4 binding agent wherein the binding agent can block the binding of CTLA-4 to its ligands.

CTLA-4 binding agent polypeptides and antibodies are within the scope of the present disclosure if they have amino acid sequences that are at least 85%, 86%, 87%, 88%, 89%, 90%, 91%, 92%, 93%, 94%, 95%, 96%, 97%, 98% or 99% identical to a variable region of at least one of antibodies A1-A28, and cross-block the binding of at least one of antibodies A1-A28 to CTLA-4, and/or are cross-blocked from binding to CTLA-4 by at least one of antibodies A1-A28; and/or can block the inhibitory effect of CTLA-4 on its ligands.

Antibodies according to the disclosure may have a binding affinity for human CTLA-4 of less than or equal to $5 \times 10^{-7}$M, less than or equal to $1 \times 10^{-7}$M, less than or equal to $0.5 \times 10^{-7}$M, less than or equal to $1 \times 10^{-8}$M, less than or equal to $1 \times 10^{-9}$M, less than or equal to $1 \times 10^{-10}$M, less than or equal to $1 \times 10^{-11}$M, or less than or equal to $1 \times 10^{-12}$ M.

The affinity of an antibody or binding partner, as well as the extent to which an antibody inhibits binding, can be determined by one of ordinary skill in the art using conventional techniques, for example those described by Scatchard et al. (*Ann. N.Y. Acad. Sci.* 51:660-672 (1949)) or by surface plasmon resonance (SPR; BIAcore, Biosensor, Piscataway, NJ). For surface plasmon resonance, target molecules are immobilized on a solid phase and exposed to ligands in a mobile phase running along a flow cell. If ligand binding to the immobilized target occurs, the local refractive index changes, leading to a change in SPR angle, which can be monitored in real time by detecting changes in the intensity of the reflected light. The rates of change of the SPR signal can be analyzed to yield apparent rate constants for the association and dissociation phases of the binding reaction. The ratio of these values gives the apparent equilibrium constant (affinity) (see, e.g., Wolff et al., *Cancer Res.* 53:2560-65 (1993)).

An antibody according to the present disclosure may belong to any immunoglobin class, for example IgG, IgE, IgM, IgD, or IgA. It may be obtained from or derived from an animal, for example, fowl (e.g., chicken) and mammals, which includes but is not limited to a mouse, rat, hamster, rabbit, or other rodent, cow, horse, sheep, goat, camel, human, or other primate. The antibody may be an internalizing antibody. Production of antibodies is disclosed generally in U.S. Patent Publication No. 2004/0146888 A1.

In the methods described above to generate antibodies according to the disclosure, including the manipulation of the specific A1-A28 CDRs into new frameworks and/or constant regions, appropriate assays are available to select the desired antibodies (i.e. assays for determining binding affinity to CTLA-4; cross-blocking assays; Biacore-based competition binding assay;" in vivo assays).

7.12.1. Methods of Treating a Disease Responsive to a CTLA-4 Inhibitor or Activator In another aspect, methods are presented for treating a subject having a disease responsive to a CTLA-4 inhibitor or activator. The disease can be cancer, autoimmune disease, or viral or bacterial infection.

The terms "treatment," "treating," and the like are used herein to generally mean obtaining a desired pharmacologic and/or physiological effect. The effect may be prophylactic, in terms of completely or partially preventing a disease, condition, or symptoms thereof, and/or may be therapeutic in terms of a partial or complete cure for a disease or condition and/or adverse effect, such as a symptom, attributable to the disease or condition. "Treatment" as used herein covers any treatment of a disease or condition of a mammal, particularly a human, and includes: (a) preventing the disease or condition from occurring in a subject which may be predisposed to the disease or condition but has not yet been diagnosed as having it; (b) inhibiting the disease or condition (e.g., arresting its development); or (c) relieving the disease or condition (e.g., causing regression of the disease or condition, providing improvement in one or more symptoms). Improvements in any conditions can be readily assessed according to standard methods and techniques known in the art. The population of subjects treated by the method of the disease includes subjects suffering from the undesirable condition or disease, as well as subjects at risk for development of the condition or disease.

By the term "therapeutically effective dose" or "effective amount" is meant a dose or amount that produces the desired effect for which it is administered. The exact dose or amount will depend on the purpose of the treatment, and will be ascertainable by one skilled in the art using known techniques (see, e.g., Lloyd (1999) The Art, Science and Technology of Pharmaceutical Compounding).

The term "sufficient amount" means an amount sufficient to produce a desired effect.

The term "therapeutically effective amount" is an amount that is effective to ameliorate a symptom of a disease. A therapeutically effective amount can be a "prophylactically effective amount" as prophylaxis can be considered therapy.

The term "ameliorating" refers to any therapeutically beneficial result in the treatment of a disease state, e.g., a neurodegenerative disease state, including prophylaxis, lessening in the severity or progression, remission, or cure thereof.

The actual amount administered, and rate and time-course of administration, will depend on the nature and severity of protein aggregation disease being treated. Prescription of treatment, e.g. decisions on dosage etc., is within the responsibility of general practitioners and other medical doctors, and typically takes account of the disorder to be treated, the condition of the individual patient, the site of delivery, the method of administration and other factors known to practitioners. Examples of the techniques and protocols mentioned above can be found in Remington's Pharmaceutical Sciences, 16th edition, Osol, A. (ed), 1980.

In some embodiments, the pharmaceutical composition is administered by inhalation, orally, by buccal administration, by sublingual administration, by injection or by topical application.

In some embodiments, the pharmaceutical composition is administered in an amount sufficient to modulate survival of neurons or dopamine release. In some embodiments, the major cannabinoid is administered in an amount less than 1 g, less than 500 mg, less than 100 mg, less than 10 mg per dose.

In some embodiments, the pharmaceutical composition is administered once a day, 2-4 times a day, 2-4 times a week, once a week, or once every two weeks.

A composition can be administered alone or in combination with other treatments, either simultaneously or sequentially dependent upon the condition to be treated. For example, the pharmaceutical composition can be administered in combination with one or more drugs targeting a different check point receptor, such as PD-1 inhibitor (e.g., anti-PD-1 antibody) or TIGIT inhibitor (e.g., anti-TIGIT antibody).

8. EXAMPLES

Below are examples of specific embodiments for carrying out the present disclosure. The examples are offered for illustrative purposes only, and are not intended to limit the scope of the present disclosure in any way. Efforts have been made to ensure accuracy with respect to numbers used (e.g., amounts, temperatures, etc.), but some experimental error and deviation should, of course, be allowed for.

The practice of the present disclosure will employ, unless otherwise indicated, conventional methods of protein chemistry, biochemistry, recombinant DNA techniques and pharmacology, within the skill of the art. Such techniques are explained fully in the literature. See, e.g., T. E. Creighton, *Proteins: Structures and Molecular Properties* (W. H. Freeman and Company, 1993); A. L. Lehninger, *Biochemistry* (Worth Publishers, Inc., current addition); Sambrook, et al., *Molecular Cloning: A Laboratory Manual* (2nd Edition, 1989); *Methods In Enzymology* (S. Colowick and N. Kaplan eds., Academic Press, Inc.); *Remington's Pharmaceutical Sciences,* 18th Edition (Easton, Pennsylvania: Mack Publishing Company, 1990); Carey and Sundberg *Advanced Organic Chemistry* $3^{rd}$ Ed. (Plenum Press) Vols A and B(1992). Furthermore, methods of generating and selecting antibodies explained in Adler et al., A natively paired antibody library yields drug leads with higher sensitivity and specificity than a randomly paired antibody library, MAbs (2018), and Adler et al., Rare, high-affinity mouse anti-CTLA-4 antibodies that function in checkpoint blockade, discovered using microfluidics and molecular genomics, MAbs (2017), which are incorporated by reference in its entirety herein, can be employed.

8.1. Example 1: Generation of Antigen Binding Protein

Mouse Immunization and Sample Preparation:

First, transgenic mice carrying inserted human immunoglobulin genes were immunized with soluble CTLA-4 immunogen of SEQ ID NO: 7001 (i.e., His-tagged CTLA-4 protein (R&D Systems)) using TiterMax as an adjuvant. One µg of immunogen was injected into each hock and 3 µg of immunogen was administered intraperitoneally, every third day for 15 days. Titer was assessed by enzyme-linked immunosorbent assay (ELISA) on a 1:2 dilution series of each animal's serum, starting at a 1:200 dilution. A final intravenous boost of 2.5 µg/hock without adjuvant was given to each animal before harvest. Lymph nodes (popliteal, inguinal, axillary, and mesenteric) were surgically removed after sacrifice. Single cell suspensions for each animal were made by manual disruption followed by passage through a 70 µm filter. Next, the EasySep™ Mouse Pan-B Cell Isolation Kit (Stemcell Technologies) negative selection kit was used to isolate B cells from each sample. The lymph node B cell populations were quantified by counting on a C-Chip hemocytometer (Incyto) and assessed for viability using Trypan blue. The cells were then diluted to 5,000-6,000 cells/mL in phosphate-buffered saline (PBS) with 12% OptiPrep™ Density Gradient Medium (Sigma). This cell mixture was used for microfluidic encapsulation. Approximately one million B cells were run from each of the six animals through an emulsion droplet microfluidics platform.

Generating Paired Heavy and Light Chain Libraries:

A DNA library encoding scFv from RNA of single cells, with native heavy-light Ig pairing intact, was generated using the emulsion droplet microfluidics platform or vortex emulsions. The method for generating the DNA library was divided into 1) poly(A)+mRNA capture, 2) multiplexed overlap extension reverse transcriptase polymerase chain reaction (OE-RT-PCR), and 3) nested PCR to remove artifacts and add adapters for deep sequencing or yeast display libraries. The scFv libraries were generated from approximately one million B cells from each animal that achieved a positive ELISA titer.

For poly(A)+mRNA capture, a custom designed co-flow emulsion droplet microfluidic chip fabricated from glass (Dolomite) was used. The microfluidic chip has two input channels for fluorocarbon oil (Dolomite), one input channel for the cell suspension mix described above, and one input channel for oligo-dT beads (NEB) at 1.25 mg/ml in cell lysis buffer (20 mM Tris pH 7.5, 0.5 M NaCl, 1 mM ethylenediaminetetraacetic acid (EDTA), 0.5% Tween-20, and 20 mM dithiothreitol). The input channels were etched to 50 µm by 150 µm for most of the chip's length, narrow to 55 µm at the droplet junction, and were coated with hydrophobic Pico-Glide (Dolomite). Three Mitos P-Pump pressure pumps (Dolomite) were used to pump the liquids through the chip. Droplet size depends on pressure, but typically droplets of ~45 mm diameter are optimally stable. Emulsions were collected into chilled 2 ml microcentrifuge tubes and incubated at 40° C. for 15 minutes for mRNA capture. The beads were extracted from the droplets using Pico-Break (Dolomite). In some embodiments, similar single cell partitioning emulsions were made using a vortex.

For multiplex OE-RT-PCR, glass Telos droplet emulsion microfluidic chips were used (Dolomite). mRNA-bound beads were re-suspended into OE-RT-PCR mix and injected into the microfluidic chips with a mineral oil-based surfactant mix (available commercially from GigaGen) at pressures that generate 27 µm droplets. The OE-RT-PCR mix contains 2× one-step RT-PCR buffer, 2.0 mM $MgSO_4$, SuperScript III reverse transcriptase, and Platinum Taq (Thermo Fisher Scientific), plus a mixture of primers directed against the IgK C region, the IgG C region, and all V regions (FIG. 2). The overlap region was a DNA sequence that encodes a Gly-Ser rich scFv linker sequence. The DNA fragments were recovered from the droplets using a droplet breaking solution (available commercially from GigaGen) and then purified using QIAquick PCR Purification Kit (Qiagen). In some embodiments, similar OE-RT-PCR emulsions were made using a vortex.

For nested PCR (FIG. 2), the purified OE-RT-PCR product was first run on a 1.7% agarose gel for 80 minutes at 150 V. A band at 1200-1500 base pair (bp) corresponding to the linked product was excised and purified using NucleoSpin Gel and PCR Clean-up Kit (Macherey Nagel). PCR was then performed to add adapters for Illumina sequencing or yeast display; for sequencing, a randomer of seven nucleotides is added to increase base calling accuracy in subsequent next generation sequencing steps. Nested PCR was performed with 2× NEBNext High-Fidelity amplification mix (NEB) with either Illumina adapter containing primers or primers for cloning into the yeast expression vector. The nested PCR product was run on a 1.2% agarose gel for 50 minutes at 150V. A band at 800-1100 bp was excised and purified using NucleoSpin Gel and PCR Clean-up Kit (Macherey Nagel).

In some embodiments, scFv libraries were not natively paired, for example, randomly paired by amplifying scFv directly from RNA isolated from B cells.

8.2. Example 2: Isolation of CTLA-4 Binders by Yeast Display

Library Screening:

Human IgG1-Fc (Thermo Fisher Scientific) and CTLA-4 (R&D Systems) proteins were biotinylated using the EZ-Link Micro Sulfo-NHS-LC-Biotinylation kit (Thermo Fisher Scientific). The biotinylation reagent was resuspended to 9 mM and added to the protein at a 50-fold molar excess. The reaction was incubated on ice for 2 hours and then the biotinylation reagent was removed using Zeba desalting columns (Thermo Fisher Scientific). The final protein concentration was calculated with a Bradford assay.

Next, the six DNA libraries were expressed as surface scFv in yeast. A yeast surface display vector (pYD) that contains a GAL1/10 promoter, an Aga2 cell wall tether, and a C-terminal c-Myc tag was built. The GAL1/10 promoter induces expression of the scFv protein in medium that contains galactose. The Aga2 cell wall tether was required to shuttle the scFv to the yeast cell surface and tether the scFv to the extracellular space. The c-Myc tag was used during the flow sort to stain for yeast cells that express in-frame scFv protein. *Saccharomyces cerevisiae* cells (ATCC) were electroporated (Bio-Rad Gene Pulser II; 0.54 kV, 25 uF, resistance set to infinity) with gel-purified nested PCR product and linearized pYD vector for homologous recombination in vivo. Transformed cells were expanded and induced with galactose to generate yeast scFv display libraries.

Two million yeast cells from the expanded scFv libraries were stained with anti-c-Myc (Thermo Fisher Scientific A21281) and an AF488-conjugated secondary antibody (Thermo Fisher Scientific A11039). To select scFv-expressing cells that bind to CTLA-4, biotinylated CTLA-4 antigen was added to the yeast culture (7 nM final) during primary antibody incubation and then stained with PE-streptavidin (Thermo Fisher Scientific). Yeast cells were flow sorted on a BD Influx (Stanford Shared FACS Facility) for double-positive cells (AF488C/PEC), and recovered clones were then plated on SD-CAA plates with kanamycin, streptomycin, and penicillin (Teknova) for expansion. The expanded first round FACS clones were then subjected to a second round of FACS with the same antigen at the same molarity (7 nM final). Plasmid minipreps (Zymo Research) were prepared from yeast recovered from the final FACS sort. Tailed-end PCR was used to add Illumina adapters to the plasmid libraries for deep sequencing.

In a typical FACS dot plot, the upper right quadrant contains yeast that stain for both antigen binding and scFv expression (identified by a C-terminal c-Myc tag). The lower left quadrant contains yeast that do not stain for either the antigen or scFv expression. The lower right quadrant contains yeast that express the scFv but do not bind the antigen. The frequency of binders in each repertoire was estimated by dividing the count of yeast that double stain for antigen and scFv expression by the count of yeast that express an scFv. Libraries generated from immunized mice yielded low percentages of scFv binders (ranging from 0.08%-1.28%) when sorted at 7 nM final antigen concentration. There was no clear association between serum titer and the frequency of binders in a repertoire. Following expansion of these sorted cells, a second round of FACS at 7 nM final antigen concentration was used to increase the specificity of the screen. The frequency of binders in the second FACS was always substantially higher than the first FACS, ranging from 8.39%-84.4%. Generally, lower frequency of binders in the first sort yielded lower frequency of binders in the second sort. Presumably, this is due to lower gating specificity for samples that have fewer bona fide binders in the original repertoire.

Deep Repertoire Sequencing:

CTLA-4-binding clones were recovered as a library ("a library of CTLA-4 binding clones"), and subjected to deep repertoire sequencing. Deep repertoire sequencing determines the sequences of all paired variable (V(D)J) regions of both heavy and light chain sequences. The library of CTLA-4 binding clones were deposited under ATCC Accession No. PTA-125512 under the Budapest Treaty on Nov. 20, 2018, under ATCC Account No. 197361 (American Type Culture Collection (ATCC), 10801 University Boulevard, Manassas, VA 20110 USA). Each clone in the library contains an scFv comprising a paired variable (V(D)J) regions of both heavy and light chain sequences originating from a single cell. Deep repertoire sequencing determines the sequences of all paired variable (V(D)J) regions of both heavy and light chain sequences. Some of the heavy and light chain sequences obtained from sequencing the yeast scFv library are provided in SEQ ID NOS: 1-28 and SEQ ID NOS: 101-128. Additional sequences obtained from sequencing the yeast scFv library are provided in SEQ ID NOS 8000-8991. Specifically, their variable light chain ($V_L$) sequences include SEQ ID NOS: 8000-8495. Their heavy chain ($V_H$) sequences include SEQ ID NOS: 8496-8991.

Deep antibody sequencing libraries were quantified using a quantitative PCR Illumina Library Quantification Kit (KAPA) and diluted to 17.5 pM. Libraries were sequenced on a MiSeq (Illumina) using a 500 cycle MiSeq Reagent Kit v2, according to the manufacturer's instructions. To obtain high quality sequence reads with maintained heavy and light chain linkage, sequencing was performed in two separate runs. In the first run ("linked run"), the scFv libraries were directly sequenced to obtain forward read of 340 cycles for the light chain V-gene and CDR3, and reverse read of 162 cycles that cover the heavy chain CDR3 and part of the heavy chain V-gene. In the second run ("unlinked run"), the scFv library was first used as a template for PCR to separately amplify heavy and light chain V-genes. Then, forward reads of 340 cycles and reverse reads of 162 cycles for the heavy and light chain Ig were obtained separately. This produces forward and reverse reads that overlap at the CDR3 and part of the V-gene, which increases confidence in nucleotide calls.

To remove base call errors, the expected number of errors (E) for a read were calculated from its Phred scores. By default, reads with E>1 were discarded, leaving reads for which the most probable number of base call errors is zero. As an additional quality filter, singleton nucleotide reads were discarded because sequences found two or more times have a high probability of being correct. Finally, high-quality, linked antibody sequences by merging filtered sequences were generated from the linked and unlinked runs. Briefly, a series of scripts that first merged forward and reverse reads from the unlinked run were written in Python. Any pairs of forward and reverse sequences that contained mismatches were discarded. Next, the nucleotide sequences from the linked run were used to query merged sequences in the unlinked run. The final output from the scripts is a series of full-length, high-quality variable (V(D)J) sequences, with native heavy and light chain Ig pairing.

To identify reading frame and FR/CDR junctions, a database of well-curated immunoglobulin sequences were first processed to generate position-specific sequence matrices (PSSMs) for each FR/CDR junction. These PSSMs were used to identify FR/CDR junctions for each of the merged nucleotide sequences generated using the processes described above. This identified the protein reading frame for each of the nucleotide sequences. CDR sequences that have a low identify score to the PSSMs are indicated by an exclamation point. Python scripts were then used to translate the sequences. Reads were required to have a valid predicted CDR3 sequence, so, for example, reads with a frame-shift between the V and J segments were discarded. Next, UBLAST was run using the scFv nucleotide sequences as queries and V and J gene sequences from the IMGT database as the reference sequences. The UBLAST alignment with the lowest E-value was used to assign V and J gene families and compute % ID to germline.

Each animal yielded 38-50 unique scFv sequences present at 0.1% frequency or greater after the second FACS selection, including a total of 28 unique scFv candidate binders (SEQ ID Nos: 1-28 for light chains; SEQ ID Nos: 101-128 for heavy chains). The light chain having a sequence of SEQ ID NO: [n] and the heavy chain having a sequence of SEQ ID NO: [100+n] are a cognate pair from a single cell, and forming a single scFv. For example, the light chain of SEQ ID NO:1 and the heavy chain of SEQ ID NO:101 are a cognate pair, the light chain of SEQ ID NO:28 and the heavy chain of SEQ ID NO:128 are a cognate pair, etc.

In this method, the two rounds of FACS resulted in enrichment of the CTLA-4-binding scFvs. In addition, many scFv were not detected in the sequencing data from the initial population of B cells from the immunized mice and most of the scFv present in the pre-sort mouse repertoires were eliminated following FACS. Therefore, this work suggests that most of the antibodies present in the repertoires of immunized mice are not strong binders to the immunogen and that this method can enrich for rare nM-affinity binders from the initial population of B cells from immunized mice.

8.3. Example 3: Biological Characteristics of Antigen Binding Protein scFv sequences that were present at low frequency in pre-sort libraries and became high frequency in post-sort libraries were then synthesized as full-length mAbs in Chinese hamster ovary (CHO) cells. These mAbs comprise the 2-3 most abundant sequences in the second round of FACS for each animal.

CTLA-4 Target Binding Profiles

The binding specificity and affinity of each full-length antibody towards CTLA-4 were determined using biolayer interferometry (BLI) and/or surface plasmon resonance (SPR). Anti-cyno CTLA-4 and anti-mouse CTLA-4 affinities were tested using ForteBio (BLI). Anti-human CTLA-4 affinities were measured using Carterra (SPR).

For BLI, antibodies were loaded onto an Anti-Human IgG Fc (AHC) biosensor using the Octet Red96 system (ForteBio). Loaded biosensors were dipped into antigen dilutions beginning at 300 nM, with 6 serial dilutions at 1:3. Kinetic analysis was performed using a 1:1 binding model and global fitting.

For SPR, we amine-coupled a moderate density (»1,000 Response Units) of an antihuman IgG-Fc reagent (Southern Biotech 2047-01) to a Xantec CMD-50M chip (50 nm carboxymethyldextran medium density of functional groups) activated with 133 mM EDC (Sigma) and 33.3 mM S-NHS (ThermoFisher) in 100 mM MES pH 5.5. Then, goat anti-Human IgG Fc (Southern Biotech 2047-01) was coupled for 10 minutes at 25 mg/m L in 10 mM Sodium Acetate pH 4.5 (Carterra Inc.). The surface was then deactivated with 1 M ethanolamine pH 8.5 (Carterra Inc.). Running buffer used for the lawn immobilization was HBS-EPC (10 mM HEPES, 150 mM NaCl, 3 mM EDTA, 0.05% Tween 20, pH 7.4; Teknova).

The sensor chip was then transferred to a continuous flow microspotter (CFM; Carterra Inc.) for array capturing. The mAb supernatants were diluted 50-fold (3-10 mg/mL final concentration) into HBS-EPC with 1 mg/mL BSA. The samples were each captured twice with 15-minute and 4-minute capture steps on the first and second prints, respectively, to create multiple densities, using a 65 mL/min flow rate. The running buffer in the CFM was also HBS-EPC.

Next, the sensor chip was loaded onto an SPR reader (MX-96 system; Ibis Technologies) for the kinetic analysis. CTLA-4 was injected at five increasing concentrations in a four-fold dilution series with concentrations of 1.95, 7.8, 31.25, 125, and 500 nM in running buffer (HBS-EPC with 1.0 mg/mL BSA). CTLA-4 injections were 5 minutes with a 15-minute dissociation at 8 mL/second in a non-regenerative kinetic series. An injection of the goat anti-Human IgG Fc capture antibody at 75 mg/mL was injected at the end of the series to verify the capture level of each mAb. Binding data was double referenced by subtracting an interspot surface and a blank injection and analyzed for ka (on-rate), kd (off-rate), and KD (affinity) using the Kinetic Interaction Tool software (Carterra Inc.).

For cell surface binding studies, stable CTLA-4 expressing Flp-In CHO (Thermo Fisher Scientific) cells were generated and mixed at a 50:50 ratio. One million cells were stained with 1 μg of the disclosed anti-CTLA-4 recombinant antibodies in 200 μl of MACS Buffer (DPBS with 0.5% bovine serum albumin and 2 mM EDTA) for 30 minutes at 4° C. Cells were then co-stained with anti-human irrelevant target APC and anti-human IgG Fc-PE [M1310G05](BioLegend 41070) antibodies for 30 minutes at 4° C. An anti-human CTLA-4-FITC antibody was used as a control for these mixing experiments and cell viability was assessed with DAPI. Flow cytometry analysis was conducted on a BD Influx at the Stanford Shared FACS Facility and data was analyzed using FlowJo.

We identified antibodies that specifically bind to CTLA-4. Affinity to CTLA-4 ($K_D$) of each antibody is provided in TABLE 6. The Promega assay % inhibition was calculated relative to the strongest inhibitor, which is antibody A5. The affinity of each antibody against human CTLA-4, the on rate, off rate, and KD are shown in TABLE 7.

TABLE 6

| Ab# | Binds by FACS? | Promega assay antagonist (EC50, ug/mL) | Promega assay % inhibition | Affinity to Human CTLA-4 (nM) | Affinity to Cyno CTLA4 (nM) | Affinity to Mouse CTLA-4 (nM) |
| --- | --- | --- | --- | --- | --- | --- |
| Ipilimumab | Yes | 0.51 | 50.2% | 4.9 | 1.3 | no binding |
| A1 | Yes | 0.13 | 43.2% | 0.77 | 0.96 | 51 |
| A2 | Yes | 0.12 | 75.4% | 5.1 | 3.1 | no binding |
| A3 | Yes | 0.18 | 49.8% | 1.5 | 1.2 | no binding |
| A4 | Yes | 0.15 | 81% | 3 | 1.2 | no binding |
| A5 | Yes | 0.18 | 100% | 4.6 | 2.2 | 39.4 |
| A6 | Yes | 0.18 | 61.7% | 5.7 | 1.6 | 87.8 |
| A7 | Yes | 0.17 | 11.5% | 5.7 | 0.75 | no binding |
| A8 | Yes | 0.15 | 54.7% | 4.6 | 1 | no binding |
| A9 | Yes | 0.19 | 60.8% | 6.8 | 0.92 | no binding |
| A10 | Yes | 0.26 | 24.5% | 22 | 3.1 | no binding |
| A11 | Yes | 0.42 | 26.6% | 7.5 | 1.6 | no binding |
| A12 | Yes | no blocking | 0% | 5.3 | 4.5 | not tested |
| A13 | Yes | 0.09 | 13.3% | 3.2 | 9.6 | not tested |
| A14 | Yes | 0.09 | 6% | 9.8 | 23.6 | not tested |
| A15 | Yes | no blocking | 0% | 10 | 2.6 | not tested |
| A16 | Yes | no blocking | 0% | 23 | 2.8 | not tested |
| A17 | Yes | no blocking | 0% | 51 | 6.3 | not tested |
| A18 | Yes | 0.89 | 8.6% | 48 | no binding | not tested |
| A19 | No | not tested | not tested | 3.3 | not tested | not tested |

TABLE 6-continued

| Ab# | Binds by FACS? | Promega assay antagonist (EC50, ug/mL) | Promega assay % inhibition | Affinity to Human CTLA-4 (nM) | Affinity to Cyno CTLA4 (nM) | Affinity to Mouse CTLA-4 (nM) |
|---|---|---|---|---|---|---|
| A20 | No | not tested | not tested | 20 | not tested | not tested |
| A21 | No | not tested | not tested | 31 | not tested | not tested |
| A22 | No | not tested | not tested | 32 | not tested | not tested |
| A23 | No | no blocking | 0% | 35 | not tested | not tested |
| A24 | No | not tested | not tested | 55 | not tested | not tested |
| A25 | No | not tested | not tested | 58 | not tested | not tested |
| A26 | No | not tested | not tested | 74 | not tested | not tested |
| A27 | No | not tested | not tested | 120 | not tested | not tested |
| A28 | No | no blocking | 0% | 46 | not tested | not tested |

TABLE 7

|  | kon (M − 1 s − 1) | koff (s − 1) | KD (M) |
|---|---|---|---|
| Ipilimumab | 6.50E+04 | 3.20E−04 | 4.90E−09 |
| A1 | 2.10E+05 | 1.60E−04 | 7.70E−10 |
| A2 | 1.00E+05 | 5.20E−04 | 5.10E−09 |
| A3 | 1.90E+05 | 2.80E−04 | 1.50E−09 |
| A4 | 7.60E+04 | 2.30E−04 | 3.00E−09 |
| A5 | 9.00E+04 | 4.20E−04 | 4.60E−09 |
| A6 | 6.10E+04 | 3.50E−04 | 5.70E−09 |
| A7 | 6.40E+04 | 3.60E−04 | 5.70E−09 |
| A8 | 8.50E+04 | 3.90E−04 | 4.60E−09 |
| A9 | 6.30E+04 | 4.30E−04 | 6.80E−09 |
| A10 | 2.30E+04 | 5.10E−04 | 2.20E−08 |
| A11 | 4.70E+04 | 3.50E−04 | 7.50E−09 |
| A12 | 5.10E+04 | 2.70E−04 | 5.30E−09 |
| A13 | 1.30E+05 | 4.20E−04 | 3.20E−09 |
| A14 | 5.40E+04 | 5.20E−04 | 9.80E−09 |
| A15 | 7.00E+04 | 7.30E−04 | 1.00E−08 |
| A16 | 3.10E+04 | 7.20E−04 | 2.30E−08 |
| A17 | 6.60E+04 | 3.40E−03 | 5.10E−08 |
| A18 | 4.20E+03 | 2.00E−04 | 4.80E−08 |
| A19 | 1.20E+05 | 3.80E−04 | 3.30E−09 |
| A20 | 3.20E+04 | 6.40E−04 | 2.00E−08 |
| A21 | 1.80E+04 | 5.50E−04 | 3.10E−08 |
| A22 | 1.10E+04 | 3.60E−04 | 3.20E−08 |
| A23 | 3.40E+04 | 1.20E−03 | 3.50E−08 |
| A24 | 2.50E+04 | 1.40E−03 | 5.50E−08 |
| A25 | 3.00E+04 | 1.80E−03 | 5.80E−08 |
| A26 | 3.50E+03 | 2.60E−04 | 7.40E−08 |
| A27 | 3.10E+04 | 3.60E−03 | 1.20E−07 |
| A28 | 5.20E+04 | 2.40E−03 | 4.60E−08 |

CTLA-4 Ligand Blocking Assay:

For analysis of the antibodies' ability to block the CTLA-4/ligand interaction, the CTLA-4 Blockade Bioassay (Promega) was used according to the manufacturer's instructions. On the day prior to the assay, aAPC/Raji cells that express CTLA-4 ligands CD80 and CD86 were thawed into 90% Ham's F-12/10% fetal bovine serum (FBS) and plated into the inner 60 wells of two 96-well plates. The cells were incubated overnight at 37° C., 5% C02. On the day of assay, antibodies were diluted in 99% RPMI/1% FBS. The antibody dilutions were added to the wells containing the CTLA-4 ligand expressing aAPC/Raji cells, followed by addition of CTLA-4 effector cells (thawed into 99% RPMI/1% FBS). The cell/antibody mixtures were incubated at 37° C., 5% $CO_2$ for 6 hours, after which Bio-Glo Reagent was added and luminescence was read using a Spectramax i3x plate reader (Molecular Devices). Fold-induction was plotted by calculating the ratio of [signal with antibody]/[signal with no antibody], and the plots were used to calculate the EC50 using SoftMax Pro (Molecular Devices). In-house produced ipilimumab was used as a positive control, and an antibody binding to an irrelevant antigen was used as a negative control.

Binding of CTLA-4 to its ligand leads to inhibition of T cell signaling. Antibodies that bind CTLA-4 and antagonize CTLA-4/ligand interactions can therefore remove this inhibition, allowing T cells to be activated. CTLA-4/ligand checkpoint blockade was tested through an in vitro cellular Nuclear Factor of Activated T cells (NFAT) luciferase reporter assay. In this assay, antibodies whose anti-CTLA-4 epitopes fall inside the ligand binding domain antagonize CTLA-4/ligand interactions, resulting in an increase of the NFAT-luciferase reporter. The full-length mAb candidates that can bind CTLA-4 expressed in CHO cells were assayed. To generate an EC50 value for each mAb, measurements were made across several concentrations. It was found that some full-length mAbs are functional in checkpoint blockade in a dose dependent manner as summarized in TABLE 6.

The ability of the CTLA4 antibodies (indicated in TABLE 8) to prevent the binding of CD80 or CD86 to plate-bound CTLA4 was evaluated using ELISA. The EC50 and the percent inhibition of each interaction is shown in the TABLE 8. Plates were coated with rhCTLA4-Fc and then blocked with 1×PBST with 5% w/v nonfat dry milk. After blocking a dilution series of the indicated antibody was added to the plate. Then, to determine how much CD80 or CD86 was still able to bind plate bound CTLA4, after the plates were washed, rhCD80-His or rhCD86-His, respectively, was added to the plate. Unbound CD80-His/CD86-His was washed away and mouse anti-His-HRP was added. TMB was used to determine how much CD80-His/CD86-His bound to the plate bound CTLA4 in the presence of each antibody.

In some embodiments of the present disclosure, the anti-CTLA-4 antibodies function pharmacologically by antibody-dependent cell-mediated cytotoxicity (ADCC). In some embodiments of the present disclosure, immune-related toxicities related to anti-CTLA-4 antibody therapy are abrogated with an antibody that functions in ADCC but which does not function in checkpoint blockade.

TABLE 8

| Antibody | CD80 EC50 (ug/mL) | CD80 % inhibition | CD86 EC50 (ug/ml) | CD86 % inhibition |
|---|---|---|---|---|
| Ipilimumab | 0.08211 | 96.5% | 0.1136 | 90.6% |
| CTLA4.A7 | 0.9955 | 92.1% | 1.98 | 78.8% |
| CTLA4.A2 | 0.1006 | 95.4% | 0.1452 | 91.5% |
| CTLA4.A12 | 0.2427 | 89.2% | 0.3704 | 77.4% |
| CTLA4.A14 | 0.2262 | 83.7% | 0.2442 | 54.5% |
| CTLA4.A5 | 0.07049 | 96.3% | 0.1218 | 90.6% |

Epitope Binning:

Epitope binning was performed using high-throughput Array SPR in a modified classical sandwich approach. A sensor chip was functionalized using the Carterra CFM and methods similar to the SPR affinity studies, except a CMD-200M chip type was used (200 nm carboxymethyl dextran, Xantec) and mAbs were coupled at 50 mg/mL to create a surface with higher binding capacity (~3,000 reactive units immobilized). The mAb supernatants were diluted at 1:1 or 1:10 in running buffer, depending on the concentration of the mAb in the supernatant.

The sensor chip was placed in the MX-96 instrument, and the captured mAbs ("ligands") were crosslinked to the surface using the bivalent amine reactive linker bis(sulfos-uccinimidyl) suberate (BS3, ThermoFisher), which was injected for 10 minutes at 0.87 mM in water. Excess activated BS3 was neutralized with 1 M ethanolamine pH 8.5. For each binning cycle, a 7-minute injection of 250 mg/mL human IgG (Jackson ImmunoResearch 009-000-003) was used to block reference surfaces and any remaining capacity of the target spots.

Next, 250 nM CTLA-4 protein was injected onto the sensor chip, followed by injections of the diluted mAb supernatants ("analytes") or buffer blanks as negative controls. Thus, the analyte mAb only bound to the antigen if it was not competitive with the ligand mAb. At the end of each cycle, a one minute regeneration injection was performed using a solution of 4 parts Pierce IgG Elution Buffer (ThermoFisher #21004), one part 5 M NaCl (0.83 M final), and 1.25 parts 0.85% H3PO4 (0.17% final).

A network community plot algorithm was then used in an SPR epitope data analysis software package (Carterra Inc.) to determine epitope bins. Note that the clustering algorithm groups mAbs for which only analyte data are available separately from the mAbs for which both ligand and analyte data are available. This phenomenon is an artifact of the incomplete competitive matrix. mAbs with both ligand and analyte data had more mAb-mAb measurements, resulting in more mAb-mAb connections, which led to a closer relationship in the community plot.

The epitope binning showed that all the mAbs were in distinct bins from ipilimumab (FIG. 3).

8.4. Example 4: Influence of CTLA-4 ABPs on Tumor Growth

Transgenic mice expressing human CTLA-4 (hCTLA-4 KI mice) were implanted subcutaneously with MC38 tumor cells on the right flank. The hCTLA-4 KI mice were treated with one mg/kg of the indicated CTLA-4 antibody on Days 8, 11, and 14 post-implantation. Specifically, the mice were treated with a control antibody (n=8), ipilumumab (n=8), CTLA4.A2 antibody (n=8), CTLA4.A14 antibody (n=9), CTLA4.A14.2a antibody (n=8), CTLA4.A7 antibody (n=9), CTLA4.A7 antibody (n=9), and CTLA4.A12 antibody (n=8). CTLA-4.A14.2a antibody is the A14 antibody cloned onto a mouse IgG2a background, which enhances antibody-dependent cellular cytotoxicity (ADCC) activity. Tumor volume was measured and tumor growth inhibition was calculated using the formula below:

Mean % Inhibition=(mean($C$)−mean($T$))/mean($C$) *100%

T—current group value
C—control group value

Tumors were implanted subcutaneously in the right flank region with MC38 tumor cells (1×10$^6$) in 0.1 ml of PBS for tumor development. The cells in exponential growth phase were harvested and quantitated by cell counter before tumor implantation. Tumor volumes were measured twice per week in two dimensions using a caliper, and the volume will be expressed in mm$^3$ using the formula: "V=(L×W×W)/2, where V is tumor volume, L is tumor length (the longest tumor dimension) and W is tumor width (the longest tumor dimension perpendicular to L). Dosing as well as tumor and body weight measurements were conducted in a Laminar Flow Cabinet. The body weights and tumor volumes were measured by using StudyDirector™ software (version 3.1.399.19). Animals were dosed i.p. (intraperitoneally) with the indicated protein in a sterile saline solution including 0.1 mg/ml of the indicated protein. Each mouse received 10 microliters of the indicated solution per a gram of body weight, which leads to a dosing of 1 mg/kg. Animals were dosed days 0, 3, and 6 post randomization.

TABLE 9 shows the percentage of mice in which the tumor had a complete response (CR) to the treatment. At least 2 consecutive tumor measurements of 0 mm$^3$ following treatment initiation qualifies as a CR.

TABLE 9

| Antibody | % of tumors with CR |
| --- | --- |
| Control | 12.5% (1 of 8) |
| Ipilimumab | 75% (6 of 8) |
| CTLA4.A2 | 100% (8 of 8) |
| CTLA4.A14 | 66.67% (6 of 9) |
| CTLA4.A14.2a | 75% (6 of 8) |
| CTLA4.A7 | 55.6% (5 of 9) |
| CTLA4.A12 | 50% (4 of 8) |

TABLE 10 shows the percentage of mice with tumors that had a CR but then later relapsed by day 56. The group treated with CTLA4.A14.2a that had previously shown a CR had 0% relapse by day 56, indicating that ADCC can prolong the anti-tumor immunity.

TABLE 10

| Antibody | % of relapse by Day 56 in tumors that had previously shown CR |
| --- | --- |
| Ipilimumab | 16.67% (1 of 6) |
| CTLA4.A2 | 25% (2 of 8) |
| CTLA4.A14 | 33.3% (2 of 6) |
| CTLA4.A14.2a | 0% (0 of 6) |

TABLE 11 shows the mean inhibition of tumor volume over time when the hCTLA-4 KI mice implanted with MC38 tumor cells were treated with one mg/kg of the control or one mg/kg of the indicated CTLA-4 antibodies.

TABLE 11

| | Mean Inhibition | | | | | | | | | | |
|---|---|---|---|---|---|---|---|---|---|---|---|
| Study day | 8 | 11 | 14 | 17 | 21 | 24 | 27 | 29 | 31 | 35 | 38 |
| Control | n/a | n/a | n/a | n/a | n/a | n/a | n/a | n/a | n/a | n/a | n/a |
| Ipilimumab | −3.81% | 0.44% | 31.41% | 69.65% | 84.04% | 90.73% | 96.00% | 96.92% | 96.61% | 87.45% | 88.27% |
| CTLA4.A7 | −7.49% | 10.91% | 34 54% | 60.11% | 70.73% | 81.04% | 78.25% | 78.75% | 70.60% | 50.50% | 43.41% |
| CTLA4.A2 | −6.79% | −6.10% | 26.70% | 61.14% | 85.22% | 97.98% | 99.58% | 100.00% | 100.00% | 99.55% | 99.36% |
| CTLA4.A12 | −5.89% | 12.35% | 34.21% | 49.59% | 70.56% | 86.82% | 90.22% | 91.82% | 91.13% | 68.63% | 70.44% |
| CTLA4.A14 | −7.37% | −6.91% | 26.70% | 58.54% | 80.64% | 93.71% | 95.73% | 97.23% | 97.26% | 92.22% | 90.17% |
| CTLA4.A14.2a | −4.74% | −20.04% | 9.74% | 40.80% | 65.98% | 87.85% | 93.48% | 95.01% | 93.66% | 81.40% | 82.75% |

Example 5: Influence of CTLA4 ABPs on Systemic Anti-Tumor Immunity

The hCTLA4 KI mice bearing MC38 tumors were treated with the indicated anti-CTLA4 on days 8, 11, and 14 post tumor cell implantation, as explained *supra*. The mice in which tumors displayed a CR were re-challenged with implantation of MC38 cells on the opposite flank. TABLE 12 shows the individual mouse tumor volumes (mm$^3$) of the original or re-challenge tumors on the final day of the study (73 days after the original tumor cell implantation and 30 days after the re-challenge implantation). There was no growth of re-challenge tumors in mice in which the original tumor remained a CR. The 3 instances of growth seen in the re-challenge tumors were in mice in which the original tumor had started to re-grow (see TABLE 12). The results also indicated that CTLA4.A2 may induce protective systemic anti-tumor immunity even when the primary tumor (original tumor) relapses (see TABLE 13).

TABLE 12

| | Ipilimumab (original tumor) | Ipilimumab (re-challenge tumor) | CTLA4.A2 (original tumor) | CTLA4.A2 (re-challenge tumor) | CTLA4.A14 (original tumor) | CTLA4.A14 (re-challenge tumor) |
|---|---|---|---|---|---|---|
| Tumor Volume (mm$^3$) | 0 | 0 | 0 | 0 | 105.7 | 85.3 |
| | 1822.3 | 149.6 | 0 | 0 | 0 | 0 |
| | 0 | 0 | 0 | 0 | 913.3 | 98.1 |
| | 0 | 0 | 0 | 0 | 0 | 0 |
| | 0 | 0 | 1415 | 0 | 0 | 0 |
| | 0 | 0 | 0 | 0 | 0 | 0 |
| | | | 678.9 | 0 | | |
| | | | 0 | 0 | | |

TABLE 13

| Antibody | % of secondary tumors that grew if primary tumor relapsed |
|---|---|
| Ipilimumab | 100% (1 of 1) |
| CTLA4.A2 | 0% (0 of 2) |
| CTLA4.A14 | 100% (2 of 2) |

8.5. Example 6: Influence of Increased Dosage of CLTA-4 ABPs

MC38 Tumors Treated with Anti-CTLA-4

Between 2 and 8 transgenic mice expressing human CTLA-4 (hCTLA-4 KI mice) were implanted with MC38 tumor cells on the right flank. Randomization started when the mean tumor size reached 98.5 mm$^2$. The hCTLA-4 KI mice were treated with 5 mg/kg of the indicated anti-CTLA4 bi-weekly for 5 doses starting on day 0 post-randomization. The administered antibodies are shown in TABLE 14. CTLA4.A14.2a is antibody A14 cloned onto a mouse IgG2a backbone, which enhances ADCC activity. The 297 suffix denotes that the hIgG1 Fc was mutated at the N297 amino acid to eliminate glycosylation and thus Fe effector function including ADCC.

A) Tumor Growth Inhibition

Over the course of the study, tumor growth inhibition was determined using the formula below:

Mean % Inhibition=(mean(C)−mean(T))/mean(C) *100%

T—current group value

C—control group value

The results showed that antibodies lacking Fc activity had reduced efficacy overall. These antibodies were still able to induce tumor regression in some animals, indicating that anti-CTLA4 works by both Fc-dependent and Fc-independent mechanisms of action, and indicating that anti-CTLA4s lacking Fc activity, including ADCC and ADCP, can induce anti-tumor responses (TABLEs 14 and 15).

TABLE 14

| Study Day | 0 | 3 | 6 | 10 | 13 | 17 | 20 |
|---|---|---|---|---|---|---|---|
| | | | | Mean Inhibition | | | |
| 1× PBS (negative control) | n/a | n/a | n/a | n/a | n/a | n/a | n/a |
| Ipilimumab | 0.31% | −21.76% | 12.56% | 75.43% | 91.55% | 95.54% | 98.71% |
| CTLA4.A5 | 0.74% | −28.09% | −6.22% | 64.17% | 87.32% | 98.32% | 100.00% |
| CTLA4.A14 | −0.56% | −13.30% | 5.33% | 68.17% | 86.21% | 92.79% | 97.52% |
| CTLA4.A12 | 0.40% | −32.59% | −14.13% | 57.48% | 83.00% | 94.99% | 98.04% |
| CTLA4.A8 | 0.26% | −18.48% | −14.18% | 52.53% | 78.37% | 96.15% | 97.96% |
| CTLA4.A7 | −0.61% | −7.67% | 10.04% | 76.74% | 94.36% | 98.88% | 100.00% |
| CTLA4.A2 | 0.27% | −23.97% | −9.95% | 60.95% | 89.33% | 98.35% | 100.00% |
| CTLA4.A13 | −1.15% | −7.61% | 6.23% | 49.18% | 64.82% | 93.82% | 95.23% |
| CTLA4.A5.2a | 0.88% | 11.78% | 27.51% | 66.64% | 89.02% | 96.85% | 100.00% |
| CTLA4.A14.2a | 1.04% | −7.89% | 21.12% | 45.60% | 84.83% | 97.30% | 100.00% |
| Ipilimumab.297 | 0.68% | 8.27% | 21.37% | 22.75% | 16.02% | 25.70% | 26.39% |
| CTLA4.A5.297 | −0.33% | 17.56% | 18.58% | 5.70% | −15.40% | 4.65% | 13.61% |

TABLE 15

% of each group in which tumor had started to regress by day 13 post treatment initiation

| | |
|---|---|
| 1× PBS (negative control) | 0% |
| Ipilimumab | 100% |
| CTLA4.A5 | 100% |
| CTLA4.A14 | 100% |
| CTLA4.A12 | 88% |
| CTLA4.A8 | 100% |
| CTLA4.A7 | 100% |
| CTLA4.A2 | 100% |
| CTLA4.A13 | 86% |
| CTLA4.A5.2a | 100% |
| CTLA4.A14.2a | 100% |
| Ipilimumab.297 | 25% |
| CTLA4.A5.297 | 14% |

B) Histopathological Analysis:

The hCTLA-4 mice were euthanized and their right kidneys were harvested for histopathological analysis. Tissue was formalin-fixed and paraffin-embedded, and cut in 5 m sections that were placed on glass slides for standard hematoxylin and eosin (H&E) staining as well as anti-IgG and anti-C3 immunohistochemistry (IHC) staining. Stained slides were prepared as digital images. A board-certified veterinary pathologist with experience in laboratory animals and toxicologic pathology evaluated the H&E images for any findings and evaluated the anti-IgG and C3 slides for location, intensity, and percent of positive staining. Findings in H&E images were scored on a scale from 0 to 5 (0=within normal limits, 1=minimal findings or the least change discernible, 2=mild findings, 3=moderate, 4=marked, and 5=severe or to the greatest extent possible). Findings in IHC images were scored on a scale of 1 to 4 for intensity (0=negative, 1=minimal or slightly positive and 4=very dark), and as a percent of the positive cells in the glomeruli (after reviewing at least 5 glomeruli).

The H&E, immunoglobulin, or C3 stain images were scored by a blinded pathologist and the results are shown in FIG. 4. The main H&E finding was that leukocytes in the renal interstitium are not usually involved in glomeruli. Ig and C3 deposition in the glomeruli scoring are also shown in FIG. 4.

C) Alkaline Phosphatase:

The hCTLA-4 mice were also analyzed for changes in alkaline phosphatase level. The level of alkaline phosphatase in the serum was determined using comprehensive diagnostic rotors on ABAXIS VetScan VS2.

The study found that ipilimumab (IPI) elevates alkaline phosphatase levels, which may be an indication of immune-mediated hepatitis. The CTLA4 antibodies (e.g., CTLA4.A14.2A) showed a decrease in elevation of alkaline phosphatase levels (FIG. 5). This decreased elevation in alkaline phosphatase induced by the presently disclosed CTLA4 antibodies may indicate they are less likely to induce immune-mediated hepatitis than treatments such as ipilimumab.

8.6. Example 7: Influence of CTLA-4 ABPs on a Second Tumor Model

RM1 Tumors Treated with Anti-CTLA-4

Transgenic mice expressing human CTLA-4 (hCTLA-4 KI mice) were implanted with RM1 tumor cells on the right flank. (Human IgG1 isotype negative control n=7, atezolimumab n=8, n=11 for all other groups). The hCTLA4 KI mice were treated with the antibodies indicated in TABLE 16. The CTLA4 antibodies were dosed at 5 mg/kg on days 0, 3, and 6 post randomization and atezolizumab was dosed at 5 mg/kg biweekly for 3 weeks starting at day 0 post randomization. Human IgG1 isotype negative control was dosed at 5 mg/kg on Days 0, 3, and 6 post randomization. The mean inhibition of tumor growth was determined at Days 0, 4, 7, 11, 14, and 18 using the following formula:

$$\text{Mean \% Inhibition} = (\text{mean}(C) - \text{mean}(T))/\text{mean}(C) * 100\%$$

T—current group value

C—control group value

TABLE 16 shows that mean inhibition values for the control, the CTLA4 antibodies, and the atezolizumab treatments over the course of the study.

TABLE 16

| Study day | Mean Inhibition | | | | | |
|---|---|---|---|---|---|---|
| | 0 | 4 | 7 | 11 | 14 | 18 |
| Human IgG1 isotype (negative control) | n/a | n/a | n/a | n/a | n/a | n/a |
| Ipilimumab | 2.14% | 11.33% | 30.07% | 41.96% | 52.16% | 57.56% |
| CTLA4.A2 | 0.09% | −12.28% | 25.30% | 43.83% | 50.20% | 59.41% |
| CTLA4.A14 | −0.17% | −7.72% | 22.10% | 36.93% | 48.84% | 55.18% |
| Atezolizumab | 1.83% | 17.66% | 0.41% | −3.02% | −7.89% | −2.89% |
| Atezolizumab + Ipilimumab | −0.47% | −3.31% | 18.00% | 29.81% | 30.39% | 35.21% |
| Atezolizumab + CTLA4.A2 | 1.50% | −6.72% | 23.00% | 41.64% | 40.93% | 44.30% |
| Atezolizumab + CTLA4.A14 | 0.87% | 2.55% | 31.58% | 45.65% | 47.43% | 55.18% |

8.7. Example 8: Combination Treatment (Pembrolizumab and Anti-CTLA4s)

Transgenic mice expressing human CTLA-4 and PD-1 (hCTLA4-hPD1 KI mice, n=8 per treatment group) were implanted subcutaneously with 1×10$^6$ MC38 tumor cells in the right flank. The hCTLA4-hPD1 KI mice were treated with a control (1× phosphate buffered saline, or PBS); 2 mg/kg pembrolizumab (pembro) or 2 mg/kg pembro+5 mg/kg anti-CTLA4, administered i.p. with a dose volume of 10 ml/kg per animal as indicated in TABLE 17 twice weekly for three weeks starting on day 1 post-randomization. The mean (%) delta inhibition of tumor growth induced by each treatment in comparison to control treatment was calculated using the formula below and the results are shown in TABLE 17.

$$\text{Mean \%} \Delta \text{Inhibition} = ((\text{mean}(C) - \text{mean}(C_0)) - (\text{mean}(T) - \text{mean}(T_0))) / (\text{mean}(C) - \text{mean}(C_0)) * 100\%$$

T—current group value
T$_0$—current group initial value
C$_0$—control group initial value

TABLE 17

| Study day | Mean Delta Inhibition | | | | | | |
|---|---|---|---|---|---|---|---|
| | 4 | 7 | 10 | 14 | 17 | 21 | 24 |
| Control | n/a | n/a | n/a | n/a | n/a | n/a | n/a |
| Pembrolizumab | 44.33% | 44.20% | 30.78% | 20.92% | 10.08% | 8.62% | −11.94% |
| Pembrolizumab + CTLA4.A5 | 29.57% | 79.32% | 85.83% | 87.28% | 86.27% | 78.55% | 97.36% |
| Pembrolizumab + CTLA4.A1 | −82.05% | −5.30% | 41.81% | 50.97% | 55.73% | 52.23% | 66.74% |

The study showed that mice treated with pembro alone did not exhibit tumor growth inhibition at day 24, however the addition of the indicated CTLA4 antibodies increased the tumor growth inhibition over the course of the study.

At the end of the experiment, select tumors were harvested and flow cytometry was conducted to investigate intratumoral immune cell populations. The data indicate that anti-CTLA4s decrease intratumoral Treg populations while increasing intratumoral NK cell populations (FIG. 6).

8.8. Example 9: Immune Related Adverse Events

Transgenic mice expressing human CTLA-4 (hCTLA-4 KI mice) were implanted with MC38 tumor cells on the right flank. The hCTLA-4 KI mice were treated with one mg/kg of the indicated CTLA-4 antibody on days 8, 11 and 14 post-implantation. The mice were weighed on days 8, 11, 14, and 17 post-implantation. Animal counts were: n=8 for ipilimumab, n=9 for A7, n=8 for A2, n=9 for A14, and n=8 for A14.2. The percent changes in body weight of the mice receiving the indicated anti-CTLA4 treatments are shown in FIG. 7.

The mice treated with CTLA4.A7, CTLA4.A14, and CTLA4.A14.2a did not appear to exhibit weight loss after the final dose of anti-CTLA4 (FIG. 7). This finding was unexpected because immune-related Adverse Events (irAE) have been reported to be greater when anti-CTLA4s with enhanced ADCC (e.g., CTLA.A14.2a) are administered. This data suggest that anti-CTLA4s with reduced blocking activity may limit induction of irAEs even when ADCC is enhanced.

8.9. Example 10: Peripheral Flow Cytometry

Transgenic mice expressing human CTLA-4 (hCTLA-4 KI mice) were implanted with MC38 tumor cells in the right flank. The hCTLA-4 KI mice were treated with one mg/kg of the indicated CTLA-4 antibody on days 8, 11, and 14 post-implantation. Peripheral flow cytometry was performed on day 27. 100 μL of blood was used for staining. The findings from the peripheral blood flow cytometry are shown in FIGS. 8-10.

The results indicated that CTLA4.A2 and CTLA4.A14 decrease the elevation of peripheral T cells (CD3+). Enhancing ADCC with CTLA4.A14.2a increased newly activated T cells (CD69+). CTLA4.A2 and CTLA4.A14 resulted in fewer non-conventional regulatory cells (CD4+PD1+, CD4+ICOS+). (See FIG. 8).

The results also indicated that CTLA4.A2 and CTLA4.A14 better enhance CD8+ T cells. CTLA4.A2 better enhanced newly activated T cells (CD8+CD69+) and led to decreased T cell exhaustion (CD8+PD1+) relative to Ipilimumab. ICOS has been described as a pharmacodynamic marker for anti-CTLA4. Enhancing ADCC with CTLA4.A14.2a appeared to further elevate CD8+ICOS+ cells (FIG. 9). The results also indicated that CTLA4.A2 and CTLA4.A14.2a lead to decreased peripheral immune activation relative to Ipilimumab, as judged by the frequency of dendritic cells (DCs) and activated DCs (CD86+). (see FIG. 10).

8.10. Example 11: Treatment with Low Dose CTLA-4 Study

Transgenic mice expressing human CTLA-4 (hCTLA-4 KI mice) were implanted subcutaneously in the right flank region with MC38 tumor cells (1E6) in 0.1 ml of PBS for tumor development. The cells in exponential growth phase were harvested and quantitated by cell counter before tumor implantation. The hCTLA-4 KI mice were randomized when the mean tumor volume was 96.15 mm$^3$ and treated with 0.3 mg/kg of the indicated anti-CTLA4, ipilimumab, or human IgG1 isotype control (Isotype) on days 0, 3 and 6 post-randomization. Tumor volume and mean % of inhibition was determined as described in Example 4. CTLA4.A2 and CTLA4.A14 resulted in significantly higher tumor inhibition over the 18 days of the study. The results of the study are shown in TABLE 18 and FIG. 11.

TABLE 18

| Group | Dates/Study Days | | | | | |
|---|---|---|---|---|---|---|
| | Dec. 6, 2019 0 | Dec. 10, 2019 4 | Dec. 13, 2019 7 | Dec. 17, 2019 11 | Dec. 20, 2019 14 | Dec. 24, 2019 18 |
| Isotype | | | | | | |
| Ipilimumab | −0.17% | 9.33% | 18.68% | 22.37% | 27.23% | 11.84% |
| CTLA4.A2 | 0.22% | 13.00% | 23.03% | 49.09% | 60.03% | 59.54% |
| CTLA4.A14 | 0.01% | 23.39% | 35.06% | 53.05% | 57.50% | 45.41% |

9. Incorporation by Reference

All publications, patents, patent applications and other documents cited in this application are hereby incorporated by reference in their entireties for all purposes to the same extent as if each individual publication, patent, patent application or other document were individually indicated to be incorporated by reference for all purposes.

10. Equivalents

While various specific embodiments have been illustrated and described, the above specification is not restrictive. It will be appreciated that various changes can be made without departing from the spirit and scope of the present disclosure(s). Many variations will become apparent to those skilled in the art upon review of this specification.

TABLE 19 provides sequences for antibody light chains, heavy chains, CDRs, and human CTLA4.

| SEQ ID NO | Sequence | Chain (Antibody) |
|---|---|---|
| 1 | EIVLTQSPGTLSLSPGEGATLSCRASQSFSSNYLAWYQQKPGQAPRLLIYGASSRA TGIPDRFSGSGSGTDFTLTISRLEPEDFAVYYCQQYGTSPFTFGPGTKVDIK | L1 (A1) |
| 2 | EIVLTQSPGTLSLSPGERATLSCRASQSVSSSYLAWYQQKPGQAPRLLIYGASSRA TGIPDRFSGSGSGTDFTLTISRLEPEDFAVYYCQQYGRSPFTFGPGTKVDIK | L2 (A2) |
| 3 | EIVLTQSPGTLSLSPGERATLSCRASQSVSSSYLAWYQQKPGQAPRLLIYGASSRA TGIPDRFSGSGSGTDFTLTISRLEPEDFAVYYCQQYGSSPFTFGPGTKVDIK | L3 (A3) |
| 4 | EIVLTQSPGTLSLSPGDRATLSCRASQSGSSSYLAWYQQKPGQAPRLLIYGASSRA TGIPDRFSGSGSGTDFTLTISRLEPEDFAVYYCQQYGTSPFTSGPGTKVDIK | L4 (A4) |
| 5 | EIVLTQSPGTLSLSPGDRATLSCRASQSGSSSYLAWYQQKPGQAPRLLIYGASSRA TGIPDRFSGSGSGTDFTLTISRLEPEDFAVYYCQQYGTSPFTSGPGTKVDIK | L5 (A5) |
| 6 | DIQMTQSPSSLSASVGDRVTITCRASQSISSYLNWYQQKPGKAPKLLIYAASSLQS GVPSRFSGSGSGTDFTLTISSLQPEDFATYYCQQSYSTPFTFGPGTKVDIK | L6 (A6) |

TABLE 19-continued provides sequences for antibody light chains, heavy chains, CDRs, and human CTLA4.
TABLE 19

| SEQ ID NO | Sequence | Chain (Antibody) |
|---|---|---|
| 7 | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTKVDIK | L7 (A7) |
| 8 | EIVLTQSPGTLSLSPGERATLSCRASQSVSYLAWYQQKPGQAPRLLIYGASSRATGIPDRFSGSGSGTDFTLTISRLEPEDFAVYYCQQYGSSPWTFGQGTKVEIK | L8 (A8) |
| 9 | DIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGPGTKVDIK | L9 (A9) |
| 10 | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTKVDIK | L10 (A10) |
| 11 | DIQLTQSPSFLSASVGDRVTITCRASQGISSYLAWYQQKPGKAPKLLIYAASTLQSGVPSRFSGSGSGTEFTLTISSLQPEDFATYYCQQLNSYPPTFGQGTKVEIK | L11 (A11) |
| 12 | EIVLTQSPGTLSLSPGERATLSCRASQSVSSSYLAWYQQKPGQAPRLLIYGASSRATGIPDRFSGSGSGTDFTLTISRLEPEDFAVYYCQQYGTSPWTFGQGTKVEIK | L12 (A12) |
| 13 | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTKVDIK | L13 (A13) |
| 14 | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTSGQGTKVEIK | L14 (A14) |
| 15 | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTKVDIK | L15 (A15) |
| 16 | DIQMTQSPSSLSASVGDRVTITCRASQGISNYLAWYQQKPGKVPKLLIYAASTLQSGVPSRFSGSGSGTDFTLTISSLQPEDVATYYCQNYNSAPWTFGQGTKVEIK | L16 (A16) |
| 17 | DIQMTQSPSSLSASVGDRVTITCRASQAIRNDLGWYQQKPGKAPKRLIYAASSLQSGVPPRFSGSGSGTEFTLTISSLQPEDFATYYCLQHNSYPLTFGGGTKVEIK | L17 (A17) |
| 18 | EIVLTQSPGTLSLSPGERATLSCRASQSVSYLAWYQQKPGQAPRLLIYGASSRATGIPDRFSGSGSGTDFTLTISRLEPEDFAVYYCQQYGSSPWTFGQGTKVEIK | L18 (A18) |
| 19 | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSSMYTFGQGTKLEIK | L19 (A19) |
| 20 | EIVLTQSPGTLSLSPGERATLSCRASQSVSSSYLAWYQQKPGQAPRLLIYGASSRATGIPDRFSGSGSGTDFTLTISRLEPEDFAVYYCQQYGRSPFTFGPGTKVDIK | L20 (A20) |
| 21 | DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQTLQTPLTFGGGTKVEIK | L21 (A21) |
| 22 | DIQMTQSPSSLSASVGDRVTITCRASQAIRNDLGWYQQKPGKAPKRLIYAASSLQSGVPPRFSGSGSGTEFTLTISSLQPEDFATYYCLQHNSYPLTFGGGTKVEIK | L22 (A22) |
| 23 | EIVLTQSPGTLSLSPGERATLSCRASQSVSSSYLAWYQQKPGQAPRLLIYGASSRATGIPDRFSGSGSGTDFTLTISRLEPEDFAVYYCQQYGPSPWTFGQGTKVEIK | L23 (A23) |
| 24 | DIQMTQSPSSLSASVGDRVTITCRASQSISSYLNWYQQKPGKAPKLLIYAASSLQSGVPSRFSGSGSGTDFTLTISSLQPEDFATYYCQQSYRTPFTFGPGTKVDIK | L24 (A24) |
| 25 | EIVMTQSPATLSLSPGERATLSCRASQSVSSSYLSWYQQKPGQAPRLLIYGASTRATGIPARFSGSGSGTDFTLTISNLQPEDFAVYYCQQGYNLPFTAGPGTKVDIK | L25 (A25) |
| 26 | DVVMTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPITSGQGTRLEIK | L26 (A26) |
| 27 | EIVLTQSPGTLSLSPGERATLSCRASQSVSSSYLAWYQQKPGQAPRLLIYGASSRATGIPDRFSGSGSGTDFTLTISRLEPEDFAVYHCQQYGRSPWTLGQGTKVEIK | L27 (A27) |
| 28 | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTSGQGTKVEIK | L28 (A28) |
| 101 | QVQLVESGGGVVQPGRSLRLSCAASGFTFSSFGMHWVRQAPGKGLEWVAVIWYDGRNKYYVDSVKGRFTISRDNSNNTLYLQMNSLRAEDTAVYYCARGEFFGEFFDYWGQGTLVTVSSA | H1 (A1) |

TABLE 19-continued provides sequences for antibody light chains, heavy chains, CDRs, and human CTLA4.

TABLE 19

| SEQ ID NO | Sequence | Chain (Antibody) |
|---|---|---|
| 102 | QVQLVESGGGVVQPGRSLRLSCAASGFTFSNYGMNWVRQAPGKGLEWVAVIWYDGRNKHYADSVKGRFTISRDNSKNTLYLQMNSLRAEDTAVYYCARGGDWGPYFDYWGQGTLVTVSSA | H2 (A2) |
| 103 | QVQLVESGGGVVQPGRSLRLSCIASGFTFSSYGMHWVRQAPGKGLEWVAVNWYDGSNKHYADSVKGRFTISRDNSKNTLYLQMNSLRAEDTAVYYCARGGVWGPYFDYWGQGTLVTVSSA | H3 (A3) |
| 104 | QVQLVESGGGVVQPGRSLRISCAASGFTFSSYGIHWVRQAPGKGLQWVAVIWYDGRNKYYADSVKGRFTISRDNSKNTLYLQMNSLRAEDTAVYYCSRSGSFGAFDIWGQGTMVTVSSA | H4 (A4) |
| 105 | QVQLVESGGGVVQPGRSLRLSCAASGFTFSSYGMHWVRQAPGKGLEWVAVIWYDGNNKYYADSVKGRFTISRDNSKNTLYLQMYSLRAEDTAVYYCARGGILAAGIFDYWGQGTLVTVSSA | H5 (A5) |
| 106 | QVQLVESGGGVVQPGRSLRLSCAASGFTFSSYGMHWVRQAPGKGLEWVAVIWYDGSYKYYADSVKGRFTISRDDSKNTLYLQMSSLRAEDTAVYYCARAPHYAILTGYYEDYWGQGTLVTVSSA | H6 (A6) |
| 107 | QVQLVESGGGVVQPGRSLRLSCAASGFTLSSFGMHWVRQAPGKGLEWVAVIWYDGSNKYYADSVKGRFIISRDNSKTALYLQMNSLRAEDTAVYYCARAHYFGAFDIWGQGTMVTVSSA | H7 (A7) |
| 108 | QVQLVESGGGVVQPGRSLRLSCAASGFTFSRYGMHWVRQAPGKGLEWVAVIWYDGRNKYYADSVKGRFTISRDNSKNTLYLQMNSLRAEDTALYSCARAGELGPFDYWGQGTLVTVSSA | H8 (A8) |
| 109 | QVQLVESGGGVVQPGRSLRLSCAASGFTFSSHGMHWVRQAPGKGLEWVAVIWYDGSNKHYADSVKGRFTISRDNSKNTLYLQMNSLRAEDTAVYYCARGDILTGYYGYWGQGTLVTVSSA | H9 (A9) |
| 110 | QVQLVESGGGVVQPGRSLRLSCVASGFTLSSYGMHWVRQAPGKGLEWVAVIWYDGSNKHYADSVKGRFTISRDNSKNTLSLQMNSLRAEDTAVYYCARGGQLGPFDYWGQGTLVTVSSA | H10 (A10) |
| 111 | QVQLVESGGGVVQPGRSLRLSCAASGFTFSSYGMHWVRQAPGKGLEWVAVIWYDVGNKYYIDSVKGRFTISRDNSKNTLYLQMNSLRAEDTAVYYCARDYYGSGSPRHFDYWGQGTLVTVSSA | H11 (A11) |
| 112 | QVQLVESGGGVVQPGRSLRLSCAASGFTFSSYGMHWVRQAPGKGLEWVAVIWYDGSNKYYADSVKGRFTFSRDNSKNTLYLQMNSLRAEDTAVYYCARGGLMGAFDYWGQGTLVTVSSA | H12 (A12) |
| 113 | QVQLVESGGGVVQPGRSLRLSCAASGFTFSSYGMHWVRQAPGKGLEWVAVIWYDGRNKDYADSVKGRITISRDNSKNTLYLQMNSLRAEDTAVYYCARGGLLGPYFDYWGQGTLVTVSSA | H13 (A13) |
| 114 | QVQLVESGGGVVQPGRSLRLSCAASGFTFSSYGMHWVRQAPGTGLEWVAVIWYEGRNKYYADPVKGRFTISRDNSKNTLYLQMNSLRDDDTAVYYCARAGDLGAFDIWGQGTMVTVSSA | H14 (A14) |
| 115 | QVQLVESGGGVVQPGRSLRLSCAASGFTFRSYGMHWVRQAPGKGLEWVAVIWYDGSNKHYADSVKGRFTISRDNSKNTLYLQMNSLRAEDTAVYYCARNGLIGAFDIWGQGTMVTVSSA | H15 (A15) |
| 116 | QVQLVESGGGVVQPGRSLRLSCAASGFTFSSYGIHWVRQAPGKGLEWVAVIWYDGSNKYYADSVKGRFTISRDNSKNTLYLQMNSLRAEDTAVYYCARGSLLGPFDYWGQGTLVTVSSA | H16 (A16) |
| 117 | EVQLVESGGGLVQPGGSLRLSCAASGFTFSNYAMSWVRQAPGKGLEWVSAISGGGLSTYYADSVKGRFTISRDNSKNTLYLQMNSLRAEDTAVYYCAKDLLWLGFDYWGQGTLVTVSSA | H17 (A17) |
| 118 | QVQLVESGGGVVQPGRSLRLSCAASGFTFSSYGMHWVRQAPGKGLEWVAVIWYDGSNKFYADSVKGRFTISSDNSKNTLYLQMNSLRAEDTAVYYCARGGHLGSFDYWGQGTLVTVSSA | H18 (A18) |
| 119 | QVQLVQSGAEVKKPGASVKVSCKASGYTFTSYYMHWVRQAPGQGLEWMGIINPSVGSTSYAQKFQGRVTMTRDTSTSTVYMELSSLRSEDTAVYYCAREVRVRGVIIPFFDYWDQGTLVTVSSA | H19 (A19) |

TABLE 19-continued provides sequences for antibody light chains, heavy chains, CDRs, and human CTLA4.
TABLE 19

| SEQ ID NO | Sequence | Chain (Antibody) |
|---|---|---|
| 120 | QVQLVQSGAEVKKPGASVKVSCKASGYTFTSYGISWVRQAPGQGLEWMGWISAYNGNTNYAQKFQGRVTMTTDTSTSTAYMELRSLRSDDTAVYYCAKVSGYFDYWGQGTLVTVSSA | H20 (A20) |
| 121 | QVQLVESGGGVVQPGRSLRLSCAASGFTFSSYGMHWVRQAPGKGLEWVAVIWYDGNNKYYADSVKGRFTISRDNSKNTLYLHMNSLRADDTAVYYCARMLRGAPYYYGMDVWGQGTTVTVSSA | H21 (A21) |
| 122 | EVQLVESGGGLVQPGGSLRLSCAASGFTFSSYAMSWVRQAPGKGLEWVSGISGSGGSTYYADSVKGRFTISRDNSKNTLYLQMNSLRAEDTAVYYCAKLGIAWYFDVWGRGTLVTVSSA | H22 (A22) |
| 123 | QVQLVQSGAEVKKPGASVKVSCKASGYTFTSYGISWVRQAPGQGLEWMGWISAYNGNTYYAQKFQGRVTMTTDTSTSTAYVELRSLRSDDTAVYYCARVTGRDAFDIWGQGTMVTVSSA | H23 (A23) |
| 124 | QVQLVQSGAEVKKPGASVKVSCKASGYTFTSYGISWVRQAPGQGLECMGWISAYNGNTNYAQKFQGRVTMITDTSTSTAYMELRSLRSDDTAVYYCARVGPINLDYWGQGTLVTVSSA | H24 (A24) |
| 125 | QVQLVQSGAEVKKPGASVKVSCKASGYTFTNYGISWVRQAPGQGLEWMGWISVYNGNTNYAQKFQGRVTMTTDTSTSTAYMELRSLISDDTAVYYCARLGKGLFDYWGQGTLVTVSSA | H25 (A25) |
| 126 | QVQLVQSGAEVKKPGASVKVSCKASDYTFTYYGISWVRQAPGQGLEWMGWISAYNGNTNYAQKLQGRVTMTTDTSTNTAYLELRSLRSDDTAVYYCARDYYDSSGYFDYWGQGTLVTVSSA | H26 (A26) |
| 127 | QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCGRWVRGVEYWGQGTLVTVSSA | H27 (A27) |
| 128 | QVQLVESGGGVVQPGRSLGLSCAASGFTFSTYGMHWVRQAPGKGLEWVAVTLYDGSNKYYADSVKGRFTISRDNSKNTLYLQMNSLRAEDTAVYYCARASLTGSFDYWGQGTLVTVSSA | H28 (A28) |
| 1001 | QSFSSNY | CDR1-L1 (A1) |
| 1002 | QSVSSSY | CDR1-L2 (A2) |
| 1003 | QSVSSSY | CDR1-L3 (A3) |
| 1004 | QSGSSSY | CDR1-L4 (A4) |
| 1005 | QSGSSSY | CDR1-L5 (A5) |
| 1006 | QSISSY | CDR1-L6 (A6) |
| 1007 | QSVSSSY | CDR1-L7 (A7) |
| 1008 | QSVSY | CDR1-L8 (A8) |
| 1009 | QSISSY | CDR1-L9 (A9) |
| 1010 | QSVSSSY | CDR1-L10 (A10) |
| 1011 | QGISSY | CDR1-L11 (A11) |
| 1012 | QSVSSSY | CDR1-L12 (A12) |
| 1013 | QSVSSSY | CDR1-L13 (A13) |
| 1014 | QSVSSSY | CDR1-L14 (A14) |
| 1015 | QSVSSSY | CDR1-L15 (A15) |
| 1016 | QGISNY | CDR1-L16 (A16) |
| 1017 | QAIRND | CDR1-L17 (A17) |
| 1018 | QSVSY | CDR1-L18 (A18) |

TABLE 19-continued provides sequences for antibody light chains, heavy chains, CDRs, and human CTLA4.
TABLE 19

| SEQ ID NO | Sequence | Chain (Antibody) |
|---|---|---|
| 1019 | QSVSSSY | CDR1-L19 (A19) |
| 1020 | QSVSSSY | CDR1-L20 (A20) |
| 1021 | QSLLHSNGYNY | CDR1-L21 (A21) |
| 1022 | QAIRND | CDR1-L22 (A22) |
| 1023 | QSVSSSY | CDR1-L23 (A23) |
| 1024 | QSISSY | CDR1-L24 (A24) |
| 1025 | QSVSSSY | CDR1-L25 (A25) |
| 1026 | QSLVYSDGNTY | CDR1-L26 (A26) |
| 1027 | QSVSSSY | CDR1-L27 (A27) |
| 1028 | QSVSSSY | CDR1-L28 (A28) |
| 2001 | GAS | CDR2-L1 (A1) |
| 2002 | GAS | CDR2-L2 (A2) |
| 2003 | GAS | CDR2-L3 (A3) |
| 2004 | GAS | CDR2-L4 (A4) |
| 2005 | GAS | CDR2-L5 (A5) |
| 2006 | AAS | CDR2-L6 (A6) |
| 2007 | GAS | CDR2-L7 (A7) |
| 2008 | GAS | CDR2-L8 (A8) |
| 2009 | AAS | CDR2-L9 (A9) |
| 2010 | GAS | CDR2-L10 (A10) |
| 2011 | AAS | CDR2-L11 (A11) |
| 2012 | GAS | CDR2-L12 (A12) |
| 2013 | GAS | CDR2-L13 (A13) |
| 2014 | GAS | CDR2-L14 (A14) |
| 2015 | GAS | CDR2-L15 (A15) |
| 2016 | AAS | CDR2-L16 (A16) |
| 2017 | AAS | CDR2-L17 (A17) |
| 2018 | GAS | CDR2-L18 (A18) |
| 2019 | GAS | CDR2-L19 (A19) |
| 2020 | GAS | CDR2-L20 (A20) |
| 2021 | LGS | CDR2-L21 (A21) |
| 2022 | AAS | CDR2-L22 (A22) |
| 2023 | GAS | CDR2-L23 (A23) |
| 2024 | AAS | CDR2-L24 (A24) |
| 2025 | GAS | CDR2-L25 (A25) |
| 2026 | KVS | CDR2-L26 (A26) |

TABLE 19-continued provides sequences for antibody light chains, heavy chains, CDRs, and human CTLA4.
TABLE 19

| SEQ ID NO | Sequence | Chain (Antibody) |
|---|---|---|
| 2027 | GAS | CDR2-L27 (A27) |
| 2028 | GAS | CDR2-L28 (A28) |
| 3001 | QQYGTSPFT | CDR3-L1 (A1) |
| 3002 | QQYGRSPFT | CDR3-L2 (A2) |
| 3003 | QQYGSSPFT | CDR3-L3 (A3) |
| 3004 | QQYGTSPFT | CDR3-L4 (A4) |
| 3005 | QQYGTSPFT | CDR3-L5 (A5) |
| 3006 | QQSYSTPFT | CDR3-L6 (A6) |
| 3007 | QQYGSSPFT | CDR3-L7 (A7) |
| 3008 | QQYGSSPWT | CDR3-L8 (A8) |
| 3009 | QQSYSTPFT | CDR3-L9 (A9) |
| 3010 | QQYGSSPFT | CDR3-L10 (A10) |
| 3011 | QQLNSYPPT | CDR3-L11 (A11) |
| 3012 | QQYGTSPWT | CDR3-L12 (A12) |
| 3013 | QQYGSSPFT | CDR3-L13 (A13) |
| 3014 | QQYGSSPWT | CDR3-L14 (A14) |
| 3015 | QQYGSSPFT | CDR3-L15 (A15) |
| 3016 | QNYNSAPWT | CDR3-L16 (A16) |
| 3017 | LQHNSYPLT | CDR3-L17 (A17) |
| 3018 | QQYGSSPWT | CDR3-L18 (A18) |
| 3019 | QQYGSSSMYT | CDR3-L19 (A19) |
| 3020 | QQYGRSPFT | CDR3-L20 (A20) |
| 3021 | MQTLQTPLT | CDR3-L21 (A21) |
| 3022 | LQHNSYPLT | CDR3-L22 (A22) |
| 3023 | QQYGPSPWT | CDR3-L23 (A23) |
| 3024 | QQSYRTPFT | CDR3-L24 (A24) |
| 3025 | QQGYNLPFT | CDR3-L25 (A25) |
| 3026 | MQGTHWPIT | CDR3-L26 (A26) |
| 3027 | QQYGRSPWT | CDR3-L27 (A27) |
| 3028 | QQYGSSPWT | CDR3-L28 (A28) |
| 4001 | GFTFSSFG | CDR1-H1 (A1) |
| 4002 | GFTFSNYG | CDR1-H2 (A2) |
| 4003 | GFTFSSYG | CDR1-H3 (A3) |
| 4004 | GFTFSSYG | CDR1-H4 (A4) |
| 4005 | GFTFSSYG | CDR1-H5 (A5) |
| 4006 | GFTFSSYG | CDR1-H6 (A6) |

TABLE 19-continued provides sequences for antibody light chains, heavy chains, CDRs, and human CTLA4.
TABLE 19

| SEQ ID NO | Sequence | Chain (Antibody) |
|---|---|---|
| 4007 | GFTLSSFG | CDR1-H7 (A7) |
| 4008 | GFTFSRYG | CDR1-H8 (A8) |
| 4009 | GFTFSSHG | CDR1-H9 (A9) |
| 4010 | GFTLSSYG | CDR1-H10 (A10) |
| 4011 | GFTFSSYG | CDR1-H11 (A11) |
| 4012 | GFTFSSYG | CDR1-H12 (A12) |
| 4013 | GFTFSSYG | CDR1-H13 (A13) |
| 4014 | GFTFSSYG | CDR1-H14 (A14) |
| 4015 | GFTFRSYG | CDR1-H15 (A15) |
| 4016 | GFTFSSYG | CDR1-H16 (A16) |
| 4017 | GFTFSNYA | CDR1-H17 (A17) |
| 4018 | GFTFSSYG | CDR1-H18 (A18) |
| 4019 | GYTFTSYY | CDR1-H19 (A19) |
| 4020 | GYTFTSYG | CDR1-H20 (A20) |
| 4021 | GFTFSSYG | CDR1-H21 (A21) |
| 4022 | GFTFSSYA | CDR1-H22 (A22) |
| 4023 | GYTFTSYG | CDR1-H23 (A23) |
| 4024 | GYTFTSYG | CDR1-H24 (A24) |
| 4025 | GYTFTNYG | CDR1-H25 (A25) |
| 4026 | DYTFTYYG | CDR1-H26 (A26) |
| 4027 | GYTFTSYG | CDR1-H27 (A27) |
| 4028 | GFTFSTYG | CDR1-H28 (A28) |
| 5001 | IWYDGRNK | CDR2-H1 (A1) |
| 5002 | IWYDGRNK | CDR2-H2 (A2) |
| 5003 | NWYDGSNK | CDR2-H3 (A3) |
| 5004 | IWYDGRNK | CDR2-H4 (A4) |
| 5005 | IWYDGNNK | CDR2-H5 (A5) |
| 5006 | IWYDGSYK | CDR2-H6 (A6) |
| 5007 | IWYDGSNK | CDR2-H7 (A7) |
| 5008 | IWYDGRNK | CDR2-H8 (A8) |
| 5009 | IWYDGSNK | CDR2-H9 (A9) |
| 5010 | IWYDGSNK | CDR2-H10 (A10) |
| 5011 | IWYDVGNK | CDR2-H11 (A11) |
| 5012 | IWYDGSNK | CDR2-H12 (A12) |
| 5013 | IWYDGRNK | CDR2-H13 (A13) |
| 5014 | IWYEGRNK | CDR2-H14 (A14) |

TABLE 19-continued provides sequences for antibody light chains, heavy chains, CDRs, and human CTLA4.
TABLE 19

| SEQ ID NO | Sequence | Chain (Antibody) |
|---|---|---|
| 5015 | IWYDGSNK | CDR2-H15 (A15) |
| 5016 | IWYDGSNK | CDR2-H16 (A16) |
| 5017 | ISGGGLST | CDR2-H17 (A17) |
| 5018 | IWYDGSNK | CDR2-H18 (A18) |
| 5019 | INPSVGST | CDR2-H19 (A19) |
| 5020 | ISAYNGNT | CDR2-H20 (A20) |
| 5021 | IWYDGNNK | CDR2-H21 (A21) |
| 5022 | ISGSGGST | CDR2-H22 (A22) |
| 5023 | ISAYNGNT | CDR2-H23 (A23) |
| 5024 | ISAYNGNT | CDR2-H24 (A24) |
| 5025 | ISVYNGNT | CDR2-H25 (A25) |
| 5026 | ISAYNGNT | CDR2-H26 (A26) |
| 5027 | ISAYNGNT | CDR2-H27 (A27) |
| 5028 | TLYDGSNK | CDR2-H28 (A28) |
| 6001 | ARGEFFGEFFDY | CDR3-H1 (A1) |
| 6002 | ARGGDWGPYFDY | CDR3-H2 (A2) |
| 6003 | ARGGVWGPYFDY | CDR3-H3 (A3) |
| 6004 | SRSGSFGAFDI | CDR3-H4 (A4) |
| 6005 | ARGGILAAGIFDY | CDR3-H5 (A5) |
| 6006 | ARAPHYAILTGYYEDY | CDR3-H6 (A6) |
| 6007 | ARAHYFGAFDI | CDR3-H7 (A7) |
| 6008 | ARAGELGPFDY | CDR3-H8 (A8) |
| 6009 | ARGDILTGYYGY | CDR3-H9 (A9) |
| 6010 | ARGGQLGPFDY | CDR3-H10 (A10) |
| 6011 | ARDYYGSGSPRHFDY | CDR3-H11 (A11) |
| 6012 | ARGGLMGAFDY | CDR3-H12 (A12) |
| 6013 | ARGGLLGPYFDY | CDR3-H13 (A13) |
| 6014 | ARAGDLGAFDI | CDR3-H14 (A14) |
| 6015 | ARNGLIGAFDI | CDR3-H15 (A15) |
| 6016 | ARGSLLGPFDY | CDR3-H16 (A16) |
| 6017 | AKDLLWLGFDY | CDR3-H17 (A17) |
| 6018 | ARGGHLGSFDY | CDR3-H18 (A18) |
| 6019 | AREVRVRGVIIPFFDY | CDR3-H19 (A19) |
| 6020 | AKVSGYFDY | CDR3-H20 (A20) |
| 6021 | ARMLRGAPYYYGMDV | CDR3-H21 (A21) |
| 6022 | AKLGIAWYFDV | CDR3-H22 (A22) |

TABLE 19-continued provides sequences for antibody light chains, heavy chains, CDRs, and human CTLA4.

TABLE 19

| SEQ ID NO | Sequence | Chain (Antibody) |
|---|---|---|
| 6023 | ARVTGRDAFDI | CDR3-H23 (A23) |
| 6024 | ARVGPINLDY | CDR3-H24 (A24) |
| 6025 | ARLGKGLFDY | CDR3-H25 (A25) |
| 6026 | ARDYYDSSGYFDY | CDR3-H26 (A26) |
| 6027 | GRWVRGVEY | CDR3-H27 (A27) |
| 6028 | ARASLTGSFDY | CDR3-H28 (A28) |
| 7001 | MACLGFQRHKAQLNLAARTWPCTLLFFLLFIPVFCKAMHVAQPAVVLASSRGIAS FVCEYASPGKATEVRVTVLRQADSQVTEVCAATYMMGNELTFLDDSICTGTSSG NQVNLTIQGLRAMDTGLYICKVELMYPPPYYLGIGNGTQIYVIDPEPCPDSDFLLW ILAAVSSGLFFYSFLLTAVSLSKMLKKRSPLTTGVYVKMPPTEPECEKQFQPY-FIPI N | Human CTLA4 |

TABLE 20 provides the sequence identifiers for the light chain, heavy chain, and CDRs of the indicated clones

| Antibody Clone Number | SEQ ID NO | | | | | | |
|---|---|---|---|---|---|---|---|
| | Light Chain | Heavy Chain | CDR1 (Light) | CDR2 (Light) | CDR3 (Light) | CDR1 (Heavy) | CDR2 (Heavy) | CDR3 (Heavy) |
| 1 | 8000 | 8496 | 8992 | 9488 | 9984 | 10480 | 10976 | 11472 |
| 2 | 8001 | 8497 | 8993 | 9489 | 9985 | 10481 | 10977 | 11473 |
| 3 | 8002 | 8498 | 8994 | 9490 | 9986 | 10482 | 10978 | 11474 |
| 4 | 8003 | 8499 | 8995 | 9491 | 9987 | 10483 | 10979 | 11475 |
| 5 | 8004 | 8500 | 8996 | 9492 | 9988 | 10484 | 10980 | 11476 |
| 6 | 8005 | 8501 | 8997 | 9493 | 9989 | 10485 | 10981 | 11477 |
| 7 | 8006 | 8502 | 8998 | 9494 | 9990 | 10486 | 10982 | 11478 |
| 8 | 8007 | 8503 | 8999 | 9495 | 9991 | 10487 | 10983 | 11479 |
| 9 | 8008 | 8504 | 9000 | 9496 | 9992 | 10488 | 10984 | 11480 |
| 10 | 8009 | 8505 | 9001 | 9497 | 9993 | 10489 | 10985 | 11481 |
| 11 | 8010 | 8506 | 9002 | 9498 | 9994 | 10490 | 10986 | 11482 |
| 12 | 8011 | 8507 | 9003 | 9499 | 9995 | 10491 | 10987 | 11483 |
| 13 | 8012 | 8508 | 9004 | 9500 | 9996 | 10492 | 10988 | 11484 |
| 14 | 8013 | 8509 | 9005 | 9501 | 9997 | 10493 | 10989 | 11485 |
| 15 | 8014 | 8510 | 9006 | 9502 | 9998 | 10494 | 10990 | 11486 |
| 16 | 8015 | 8511 | 9007 | 9503 | 9999 | 10495 | 10991 | 11487 |
| 17 | 8016 | 8512 | 9008 | 9504 | 10000 | 10496 | 10992 | 11488 |
| 18 | 8017 | 8513 | 9009 | 9505 | 10001 | 10497 | 10993 | 11489 |
| 19 | 8018 | 8514 | 9010 | 9506 | 10002 | 10498 | 10994 | 11490 |
| 20 | 8019 | 8515 | 9011 | 9507 | 10003 | 10499 | 10995 | 11491 |
| 21 | 8020 | 8516 | 9012 | 9508 | 10004 | 10500 | 10996 | 11492 |
| 22 | 8021 | 8517 | 9013 | 9509 | 10005 | 10501 | 10997 | 11493 |
| 23 | 8022 | 8518 | 9014 | 9510 | 10006 | 10502 | 10998 | 11494 |
| 24 | 8023 | 8519 | 9015 | 9511 | 10007 | 10503 | 10999 | 11495 |
| 25 | 8024 | 8520 | 9016 | 9512 | 10008 | 10504 | 11000 | 11496 |
| 26 | 8025 | 8521 | 9017 | 9513 | 10009 | 10505 | 11001 | 11497 |
| 27 | 8026 | 8522 | 9018 | 9514 | 10010 | 10506 | 11002 | 11498 |
| 28 | 8027 | 8523 | 9019 | 9515 | 10011 | 10507 | 11003 | 11499 |
| 29 | 8028 | 8524 | 9020 | 9516 | 10012 | 10508 | 11004 | 11500 |
| 30 | 8029 | 8525 | 9021 | 9517 | 10013 | 10509 | 11005 | 11501 |
| 31 | 8030 | 8526 | 9022 | 9518 | 10014 | 10510 | 11006 | 11502 |
| 32 | 8031 | 8527 | 9023 | 9519 | 10015 | 10511 | 11007 | 11503 |
| 33 | 8032 | 8528 | 9024 | 9520 | 10016 | 10512 | 11008 | 11504 |
| 34 | 8033 | 8529 | 9025 | 9521 | 10017 | 10513 | 11009 | 11505 |
| 35 | 8034 | 8530 | 9026 | 9522 | 10018 | 10514 | 11010 | 11506 |
| 36 | 8035 | 8531 | 9027 | 9523 | 10019 | 10515 | 11011 | 11507 |
| 37 | 8036 | 8532 | 9028 | 9524 | 10020 | 10516 | 11012 | 11508 |
| 38 | 8037 | 8533 | 9029 | 9525 | 10021 | 10517 | 11013 | 11509 |
| 39 | 8038 | 8534 | 9030 | 9526 | 10022 | 10518 | 11014 | 11510 |
| 40 | 8039 | 8535 | 9031 | 9527 | 10023 | 10519 | 11015 | 11511 |
| 41 | 8040 | 8536 | 9032 | 9528 | 10024 | 10520 | 11016 | 11512 |
| 42 | 8041 | 8537 | 9033 | 9529 | 10025 | 10521 | 11017 | 11513 |

TABLE 20-continued provides the sequence identifiers for the light chain, heavy chain, and CDRs of the indicated clones

| Antibody Clone Number | SEQ ID NO | | | | | | | |
|---|---|---|---|---|---|---|---|---|
| | Light Chain | Heavy Chain | CDR1 (Light) | CDR2 (Light) | CDR3 (Light) | CDR1 (Heavy) | CDR2 (Heavy) | CDR3 (Heavy) |
| 43 | 8042 | 8538 | 9034 | 9530 | 10026 | 10522 | 11018 | 11514 |
| 44 | 8043 | 8539 | 9035 | 9531 | 10027 | 10523 | 11019 | 11515 |
| 45 | 8044 | 8540 | 9036 | 9532 | 10028 | 10524 | 11020 | 11516 |
| 46 | 8045 | 8541 | 9037 | 9533 | 10029 | 10525 | 11021 | 11517 |
| 47 | 8046 | 8542 | 9038 | 9534 | 10030 | 10526 | 11022 | 11518 |
| 48 | 8047 | 8543 | 9039 | 9535 | 10031 | 10527 | 11023 | 11519 |
| 49 | 8048 | 8544 | 9040 | 9536 | 10032 | 10528 | 11024 | 11520 |
| 50 | 8049 | 8545 | 9041 | 9537 | 10033 | 10529 | 11025 | 11521 |
| 51 | 8050 | 8546 | 9042 | 9538 | 10034 | 10530 | 11026 | 11522 |
| 52 | 8051 | 8547 | 9043 | 9539 | 10035 | 10531 | 11027 | 11523 |
| 53 | 8052 | 8548 | 9044 | 9540 | 10036 | 10532 | 11028 | 11524 |
| 54 | 8053 | 8549 | 9045 | 9541 | 10037 | 10533 | 11029 | 11525 |
| 55 | 8054 | 8550 | 9046 | 9542 | 10038 | 10534 | 11030 | 11526 |
| 56 | 8055 | 8551 | 9047 | 9543 | 10039 | 10535 | 11031 | 11527 |
| 57 | 8056 | 8552 | 9048 | 9544 | 10040 | 10536 | 11032 | 11528 |
| 58 | 8057 | 8553 | 9049 | 9545 | 10041 | 10537 | 11033 | 11529 |
| 59 | 8058 | 8554 | 9050 | 9546 | 10042 | 10538 | 11034 | 11530 |
| 60 | 8059 | 8555 | 9051 | 9547 | 10043 | 10539 | 11035 | 11531 |
| 61 | 8060 | 8556 | 9052 | 9548 | 10044 | 10540 | 11036 | 11532 |
| 62 | 8061 | 8557 | 9053 | 9549 | 10045 | 10541 | 11037 | 11533 |
| 63 | 8062 | 8558 | 9054 | 9550 | 10046 | 10542 | 11038 | 11534 |
| 64 | 8063 | 8559 | 9055 | 9551 | 10047 | 10543 | 11039 | 11535 |
| 65 | 8064 | 8560 | 9056 | 9552 | 10048 | 10544 | 11040 | 11536 |
| 66 | 8065 | 8561 | 9057 | 9553 | 10049 | 10545 | 11041 | 11537 |
| 67 | 8066 | 8562 | 9058 | 9554 | 10050 | 10546 | 11042 | 11538 |
| 68 | 8067 | 8563 | 9059 | 9555 | 10051 | 10547 | 11043 | 11539 |
| 69 | 8068 | 8564 | 9060 | 9556 | 10052 | 10548 | 11044 | 11540 |
| 70 | 8069 | 8565 | 9061 | 9557 | 10053 | 10549 | 11045 | 11541 |
| 71 | 8070 | 8566 | 9062 | 9558 | 10054 | 10550 | 11046 | 11542 |
| 72 | 8071 | 8567 | 9063 | 9559 | 10055 | 10551 | 11047 | 11543 |
| 73 | 8072 | 8568 | 9064 | 9560 | 10056 | 10552 | 11048 | 11544 |
| 74 | 8073 | 8569 | 9065 | 9561 | 10057 | 10553 | 11049 | 11545 |
| 75 | 8074 | 8570 | 9066 | 9562 | 10058 | 10554 | 11050 | 11546 |
| 76 | 8075 | 8571 | 9067 | 9563 | 10059 | 10555 | 11051 | 11547 |
| 77 | 8076 | 8572 | 9068 | 9564 | 10060 | 10556 | 11052 | 11548 |
| 78 | 8077 | 8573 | 9069 | 9565 | 10061 | 10557 | 11053 | 11549 |
| 79 | 8078 | 8574 | 9070 | 9566 | 10062 | 10558 | 11054 | 1550 |
| 80 | 8079 | 8575 | 9071 | 9567 | 10063 | 10559 | 11055 | 11551 |
| 81 | 8080 | 8576 | 9072 | 9568 | 10064 | 10560 | 11056 | 11552 |
| 82 | 8081 | 8577 | 9073 | 9569 | 10065 | 10561 | 11057 | 11553 |
| 83 | 8082 | 8578 | 9074 | 9570 | 10066 | 10562 | 11058 | 11554 |
| 84 | 8083 | 8579 | 9075 | 9571 | 10067 | 10563 | 11059 | 11555 |
| 85 | 8084 | 8580 | 9076 | 9572 | 10068 | 10564 | 11060 | 11556 |
| 86 | 8085 | 8581 | 9077 | 9573 | 10069 | 10565 | 11061 | 11557 |
| 87 | 8086 | 8582 | 9078 | 9574 | 10070 | 10566 | 11062 | 11558 |
| 88 | 8087 | 8583 | 9079 | 9575 | 10071 | 10567 | 11063 | 11559 |
| 89 | 8088 | 8584 | 9080 | 9576 | 10072 | 10568 | 11064 | 11560 |
| 90 | 8089 | 8585 | 9081 | 9577 | 10073 | 10569 | 11065 | 11561 |
| 91 | 8090 | 8586 | 9082 | 9578 | 10074 | 10570 | 11066 | 11562 |
| 92 | 8091 | 8587 | 9083 | 9579 | 10075 | 10571 | 11067 | 11563 |
| 93 | 8092 | 8588 | 9084 | 9580 | 10076 | 10572 | 11068 | 11564 |
| 94 | 8093 | 8589 | 9085 | 9581 | 10077 | 10573 | 11069 | 11565 |
| 95 | 8094 | 8590 | 9086 | 9582 | 10078 | 10574 | 11070 | 11566 |
| 96 | 8095 | 8591 | 9087 | 9583 | 10079 | 10575 | 11071 | 11567 |
| 97 | 8096 | 8592 | 9088 | 9584 | 10080 | 10576 | 11072 | 11568 |
| 98 | 8097 | 8593 | 9089 | 9585 | 10081 | 10577 | 11073 | 11569 |
| 99 | 8098 | 8594 | 9090 | 9586 | 10082 | 10578 | 11074 | 11570 |
| 100 | 8099 | 8595 | 9091 | 9587 | 10083 | 10579 | 11075 | 11571 |
| 101 | 8100 | 8596 | 9092 | 9588 | 10084 | 10580 | 11076 | 11572 |
| 102 | 8101 | 8597 | 9093 | 9589 | 10085 | 10581 | 11077 | 11573 |
| 103 | 8102 | 8598 | 9094 | 9590 | 10086 | 10582 | 11078 | 11574 |
| 104 | 8103 | 8599 | 9095 | 9591 | 10087 | 10583 | 11079 | 11575 |
| 105 | 8104 | 8600 | 9096 | 9592 | 10088 | 10584 | 11080 | 11576 |
| 106 | 8105 | 8601 | 9097 | 9593 | 10089 | 10585 | 11081 | 11577 |
| 107 | 8106 | 8602 | 9098 | 9594 | 10090 | 10586 | 11082 | 11578 |
| 108 | 8107 | 8603 | 9099 | 9595 | 10091 | 10587 | 11083 | 11579 |
| 109 | 8108 | 8604 | 9100 | 9596 | 10092 | 10588 | 1084 | 11580 |
| 110 | 8109 | 8605 | 9101 | 9597 | 10093 | 10589 | 11085 | 11581 |
| 111 | 8110 | 8606 | 9102 | 9598 | 10094 | 10590 | 11086 | 11582 |
| 112 | 8111 | 8607 | 9103 | 9599 | 10095 | 10591 | 11087 | 11583 |
| 113 | 8112 | 8608 | 9104 | 9600 | 10096 | 10592 | 11088 | 11584 |
| 114 | 8113 | 8609 | 9105 | 9601 | 10097 | 10593 | 11089 | 11585 |
| 115 | 8114 | 8610 | 9106 | 9602 | 10098 | 10594 | 11090 | 11586 |

TABLE 20-continued provides the sequence identifiers for the light chain, heavy chain, and CDRs of the indicated clones

| Antibody Clone Number | SEQ ID NO | | | | | | | |
|---|---|---|---|---|---|---|---|---|
| | Light Chain | Heavy Chain | CDR1 (Light) | CDR2 (Light) | CDR3 (Light) | CDR1 (Heavy) | CDR2 (Heavy) | CDR3 (Heavy) |
| 116 | 8115 | 8611 | 9107 | 9603 | 10099 | 10595 | 11091 | 11587 |
| 117 | 8116 | 8612 | 9108 | 9604 | 10100 | 10596 | 11092 | 11588 |
| 118 | 8117 | 8613 | 9109 | 9605 | 10101 | 10597 | 11093 | 11589 |
| 119 | 8118 | 8614 | 9110 | 9606 | 10102 | 10598 | 11094 | 11590 |
| 120 | 8119 | 8615 | 9111 | 9607 | 10103 | 10599 | 11095 | 11591 |
| 121 | 8120 | 8616 | 9112 | 9608 | 10104 | 10600 | 11096 | 11592 |
| 122 | 8121 | 8617 | 9113 | 9609 | 10105 | 10601 | 11097 | 11593 |
| 123 | 8122 | 8618 | 9114 | 9610 | 10106 | 10602 | 11098 | 11594 |
| 124 | 8123 | 8619 | 9115 | 9611 | 10107 | 10603 | 11099 | 11595 |
| 125 | 8124 | 8620 | 9116 | 9612 | 10108 | 10604 | 11100 | 11596 |
| 126 | 8125 | 8621 | 9117 | 9613 | 10109 | 10605 | 11101 | 11597 |
| 127 | 8126 | 8622 | 9118 | 9614 | 10110 | 10606 | 11102 | 11598 |
| 128 | 8127 | 8623 | 9119 | 9615 | 10111 | 10607 | 11103 | 11599 |
| 129 | 8128 | 8624 | 9120 | 9616 | 10112 | 10608 | 11104 | 11600 |
| 130 | 8129 | 8625 | 9121 | 9617 | 10113 | 10609 | 11105 | 11601 |
| 131 | 8130 | 8626 | 9122 | 9618 | 10114 | 10610 | 11106 | 11602 |
| 132 | 8131 | 8627 | 9123 | 9619 | 10115 | 10611 | 11107 | 11603 |
| 133 | 8132 | 8628 | 9124 | 9620 | 10116 | 10612 | 11108 | 11604 |
| 134 | 8133 | 8629 | 9125 | 9621 | 10117 | 10613 | 11109 | 11605 |
| 135 | 8134 | 8630 | 9126 | 9622 | 10118 | 10614 | 11110 | 11606 |
| 136 | 8135 | 8631 | 9127 | 9623 | 10119 | 10615 | 11111 | 11607 |
| 137 | 8136 | 8632 | 9128 | 9624 | 10120 | 10616 | 11112 | 11608 |
| 138 | 8137 | 8633 | 9129 | 9625 | 10121 | 10617 | 11113 | 11609 |
| 139 | 8138 | 8634 | 9130 | 9626 | 10122 | 10618 | 11114 | 11610 |
| 140 | 8139 | 8635 | 9131 | 9627 | 10123 | 10619 | 11115 | 11611 |
| 141 | 8140 | 8636 | 9132 | 9628 | 10124 | 10620 | 11116 | 11612 |
| 142 | 8141 | 8637 | 9133 | 9629 | 10125 | 10621 | 11117 | 11613 |
| 143 | 8142 | 8638 | 9134 | 9630 | 10126 | 10622 | 11118 | 11614 |
| 144 | 8143 | 8639 | 9135 | 9631 | 10127 | 10623 | 11119 | 11615 |
| 145 | 8144 | 8640 | 9136 | 9632 | 10128 | 10624 | 11120 | 11616 |
| 146 | 8145 | 8641 | 9137 | 9633 | 10129 | 10625 | 11121 | 11617 |
| 147 | 8146 | 8642 | 9138 | 9634 | 10130 | 10626 | 11122 | 11618 |
| 148 | 8147 | 8643 | 9139 | 9635 | 10131 | 10627 | 11123 | 11619 |
| 149 | 8148 | 8644 | 9140 | 9636 | 10132 | 10628 | 11124 | 11620 |
| 150 | 8149 | 8645 | 9141 | 9637 | 10133 | 10629 | 11125 | 11621 |
| 151 | 8150 | 8646 | 9142 | 9638 | 10134 | 10630 | 11126 | 11622 |
| 152 | 8151 | 8647 | 9143 | 9639 | 10135 | 10631 | 11127 | 11623 |
| 153 | 8152 | 8648 | 9144 | 9640 | 10136 | 10632 | 11128 | 11624 |
| 154 | 8153 | 8649 | 9145 | 9641 | 10137 | 10633 | 11129 | 11625 |
| 155 | 8154 | 8650 | 9146 | 9642 | 10138 | 10634 | 11130 | 11626 |
| 156 | 8155 | 8651 | 9147 | 9643 | 10139 | 10635 | 11131 | 11627 |
| 157 | 8156 | 8652 | 9148 | 9644 | 10140 | 10636 | 11132 | 11628 |
| 158 | 8157 | 8653 | 9149 | 9645 | 10141 | 10637 | 11133 | 11629 |
| 159 | 8158 | 8654 | 9150 | 9646 | 10142 | 10638 | 11134 | 11630 |
| 160 | 8159 | 8655 | 9151 | 9647 | 10143 | 10639 | 11135 | 11631 |
| 161 | 8160 | 8656 | 9152 | 9648 | 10144 | 10640 | 11136 | 11632 |
| 162 | 8161 | 8657 | 9153 | 9649 | 10145 | 10641 | 11137 | 11633 |
| 163 | 8162 | 8658 | 9154 | 9650 | 10146 | 10642 | 11138 | 11634 |
| 164 | 8163 | 8659 | 9155 | 9651 | 10147 | 10643 | 11139 | 11635 |
| 165 | 8164 | 8660 | 9156 | 9652 | 10148 | 10644 | 11140 | 11636 |
| 166 | 8165 | 8661 | 9157 | 9653 | 10149 | 10645 | 11141 | 11637 |
| 167 | 8166 | 8662 | 9158 | 9654 | 10150 | 10646 | 11142 | 11638 |
| 168 | 8167 | 8663 | 9159 | 9655 | 10151 | 10647 | 11143 | 11639 |
| 169 | 8168 | 8664 | 9160 | 9656 | 10152 | 10648 | 11144 | 11640 |
| 170 | 8169 | 8665 | 9161 | 9657 | 10153 | 10649 | 11145 | 11641 |
| 171 | 8170 | 8666 | 9162 | 9658 | 10154 | 10650 | 11146 | 11642 |
| 172 | 8171 | 8667 | 9163 | 9659 | 10155 | 10651 | 11147 | 11643 |
| 173 | 8172 | 8668 | 9164 | 9660 | 10156 | 10652 | 11148 | 11644 |
| 174 | 8173 | 8669 | 9165 | 9661 | 10157 | 10653 | 11149 | 11645 |
| 175 | 8174 | 8670 | 9166 | 9662 | 10158 | 10654 | 11150 | 11646 |
| 176 | 8175 | 8671 | 9167 | 9663 | 10159 | 10655 | 11151 | 11647 |
| 177 | 8176 | 8672 | 9168 | 9664 | 10160 | 10656 | 11152 | 11648 |
| 178 | 8177 | 8673 | 9169 | 9665 | 10161 | 10657 | 11153 | 11649 |
| 179 | 8178 | 8674 | 9170 | 9666 | 10162 | 10658 | 11154 | 11650 |
| 180 | 8179 | 8675 | 9171 | 9667 | 10163 | 10659 | 11155 | 11651 |
| 181 | 8180 | 8676 | 9172 | 9668 | 10164 | 10660 | 11156 | 11652 |
| 182 | 8181 | 8677 | 9173 | 9669 | 10165 | 10661 | 11157 | 11653 |
| 183 | 8182 | 8678 | 9174 | 9670 | 10166 | 10662 | 11158 | 11654 |
| 184 | 8183 | 8679 | 9175 | 9671 | 10167 | 10663 | 11159 | 11655 |
| 185 | 8184 | 8680 | 9176 | 9672 | 10168 | 10664 | 11160 | 11656 |
| 186 | 8185 | 8681 | 9177 | 9673 | 10169 | 10665 | 11161 | 11657 |
| 187 | 8186 | 8682 | 9178 | 9674 | 10170 | 10666 | 11162 | 11658 |
| 188 | 8187 | 8683 | 9179 | 9675 | 10171 | 10667 | 11163 | 11659 |

TABLE 20-continued provides the sequence identifiers for the light chain, heavy chain, and CDRs of the indicated clones

| Antibody Clone Number | SEQ ID NO | | | | | | | |
|---|---|---|---|---|---|---|---|---|
| | Light Chain | Heavy Chain | CDR1 (Light) | CDR2 (Light) | CDR3 (Light) | CDR1 (Heavy) | CDR2 (Heavy) | CDR3 (Heavy) |
| 189 | 8188 | 8684 | 9180 | 9676 | 10172 | 10668 | 11164 | 11660 |
| 190 | 8189 | 8685 | 9181 | 9677 | 10173 | 10669 | 11165 | 11661 |
| 191 | 8190 | 8686 | 9182 | 9678 | 10174 | 10670 | 11166 | 11662 |
| 192 | 8191 | 8687 | 9183 | 9679 | 10175 | 10671 | 11167 | 11663 |
| 193 | 8192 | 8688 | 9184 | 9680 | 10176 | 10672 | 11168 | 11664 |
| 194 | 8193 | 8689 | 9185 | 9681 | 10177 | 10673 | 11169 | 11665 |
| 195 | 8194 | 8690 | 9186 | 9682 | 10178 | 10674 | 11170 | 11666 |
| 196 | 8195 | 8691 | 9187 | 9683 | 10179 | 10675 | 11171 | 11667 |
| 197 | 8196 | 8692 | 9188 | 9684 | 10180 | 10676 | 11172 | 11668 |
| 198 | 8197 | 8693 | 9189 | 9685 | 10181 | 10677 | 11173 | 11669 |
| 199 | 8198 | 8694 | 9190 | 9686 | 10182 | 10678 | 11174 | 11670 |
| 200 | 8199 | 8695 | 9191 | 9687 | 10183 | 10679 | 11175 | 11671 |
| 201 | 8200 | 8696 | 9192 | 9688 | 10184 | 10680 | 11176 | 11672 |
| 202 | 8201 | 8697 | 9193 | 9689 | 10185 | 10681 | 11177 | 11673 |
| 203 | 8202 | 8698 | 9194 | 9690 | 10186 | 10682 | 11178 | 11674 |
| 204 | 8203 | 8699 | 9195 | 9691 | 10187 | 10683 | 11179 | 11675 |
| 205 | 8204 | 8700 | 9196 | 9692 | 10188 | 10684 | 11180 | 11676 |
| 206 | 8205 | 8701 | 9197 | 9693 | 10189 | 10685 | 11181 | 11677 |
| 207 | 8206 | 8702 | 9198 | 9694 | 10190 | 10686 | 11182 | 11678 |
| 208 | 8207 | 8703 | 9199 | 9695 | 10191 | 10687 | 11183 | 11679 |
| 209 | 8208 | 8704 | 9200 | 9696 | 10192 | 10688 | 11184 | 11680 |
| 210 | 8209 | 8705 | 9201 | 9697 | 10193 | 10689 | 11185 | 11681 |
| 211 | 8210 | 8706 | 9202 | 9698 | 10194 | 10690 | 11186 | 11682 |
| 212 | 8211 | 8707 | 9203 | 9699 | 10195 | 10691 | 11187 | 11683 |
| 213 | 8212 | 8708 | 9204 | 9700 | 10196 | 10692 | 11188 | 11684 |
| 214 | 8213 | 8709 | 9205 | 9701 | 10197 | 10693 | 11189 | 11685 |
| 215 | 8214 | 8710 | 9206 | 9702 | 10198 | 10694 | 11190 | 11686 |
| 216 | 8215 | 8711 | 9207 | 9703 | 10199 | 10695 | 11191 | 11687 |
| 217 | 8216 | 8712 | 9208 | 9704 | 10200 | 10696 | 11192 | 11688 |
| 218 | 8217 | 8713 | 9209 | 9705 | 10201 | 10697 | 11193 | 11689 |
| 219 | 8218 | 8714 | 9210 | 9706 | 10202 | 10698 | 11194 | 11690 |
| 220 | 8219 | 8715 | 9211 | 9707 | 10203 | 10699 | 11195 | 11691 |
| 221 | 8220 | 8716 | 9212 | 9708 | 10204 | 10700 | 11196 | 11692 |
| 222 | 8221 | 8717 | 9213 | 9709 | 10205 | 10701 | 11197 | 11693 |
| 223 | 8222 | 8718 | 9214 | 9710 | 10206 | 10702 | 11198 | 11694 |
| 224 | 8223 | 8719 | 9215 | 9711 | 10207 | 10703 | 11199 | 11695 |
| 225 | 8224 | 8720 | 9216 | 9712 | 10208 | 10704 | 11200 | 11696 |
| 226 | 8225 | 8721 | 9217 | 9713 | 10209 | 10705 | 11201 | 11697 |
| 227 | 8226 | 8722 | 9218 | 9714 | 10210 | 10706 | 11202 | 11698 |
| 228 | 8227 | 8723 | 9219 | 9715 | 10211 | 10707 | 11203 | 11699 |
| 229 | 8228 | 8724 | 9220 | 9716 | 10212 | 10708 | 11204 | 11700 |
| 230 | 8229 | 8725 | 9221 | 9717 | 10213 | 10709 | 11205 | 11701 |
| 231 | 8230 | 8726 | 9222 | 9718 | 10214 | 10710 | 1120€ | 11702 |
| 232 | 8231 | 8727 | 9223 | 9719 | 10215 | 10711 | 11207 | 11703 |
| 233 | 8232 | 8728 | 9224 | 9720 | 10216 | 10712 | 11208 | 11704 |
| 234 | 8233 | 8729 | 9225 | 9721 | 10217 | 10713 | 11209 | 11705 |
| 235 | 8234 | 8730 | 9226 | 9722 | 10218 | 10714 | 11210 | 11706 |
| 236 | 8235 | 8731 | 9227 | 9723 | 10219 | 10715 | 11211 | 11707 |
| 237 | 8236 | 8732 | 9228 | 9724 | 10220 | 10716 | 11212 | 11708 |
| 238 | 8237 | 8733 | 9229 | 9725 | 10221 | 10717 | 11213 | 11709 |
| 239 | 8238 | 8734 | 9230 | 9726 | 10222 | 10718 | 11214 | 11710 |
| 240 | 8239 | 8735 | 9231 | 9727 | 10223 | 10719 | 11215 | 11711 |
| 241 | 8240 | 8736 | 9232 | 9728 | 10224 | 10720 | 11216 | 11712 |
| 242 | 8241 | 8737 | 9233 | 9729 | 10225 | 10721 | 11217 | 11713 |
| 243 | 8242 | 8738 | 9234 | 9730 | 10226 | 10722 | 11218 | 11714 |
| 244 | 8243 | 8739 | 9235 | 9731 | 10227 | 10723 | 11219 | 11715 |
| 245 | 8244 | 8740 | 9236 | 9732 | 10228 | 10724 | 11220 | 11716 |
| 246 | 8245 | 8741 | 9237 | 9733 | 10229 | 10725 | 11221 | 11717 |
| 247 | 8246 | 8742 | 9238 | 9734 | 10230 | 10726 | 11222 | 11718 |
| 248 | 8247 | 8743 | 9239 | 9735 | 10231 | 10727 | 11223 | 11719 |
| 249 | 8248 | 8744 | 9240 | 9736 | 10232 | 10728 | 11224 | 11720 |
| 250 | 8249 | 8745 | 9241 | 9737 | 10233 | 10729 | 11225 | 11721 |
| 251 | 8250 | 8746 | 9242 | 9738 | 10234 | 10730 | 11226 | 11722 |
| 252 | 8251 | 8747 | 9243 | 9739 | 10235 | 10731 | 11227 | 11723 |
| 253 | 8252 | 8748 | 9244 | 9740 | 10236 | 10732 | 11228 | 11724 |
| 254 | 8253 | 8749 | 9245 | 9741 | 10237 | 10733 | 11229 | 11725 |
| 255 | 8254 | 8750 | 9246 | 9742 | 10238 | 10734 | 11230 | 11726 |
| 256 | 8255 | 8751 | 9247 | 9743 | 10239 | 10735 | 11231 | 11727 |
| 257 | 8256 | 8752 | 9248 | 9744 | 10240 | 10736 | 11232 | 11728 |
| 258 | 8257 | 8753 | 9249 | 9745 | 10241 | 10737 | 11233 | 11729 |
| 259 | 8258 | 8754 | 9250 | 9746 | 10242 | 10738 | 11234 | 11730 |
| 260 | 8259 | 8755 | 9251 | 9747 | 10243 | 10739 | 11235 | 11731 |
| 261 | 8260 | 8756 | 9252 | 9748 | 10244 | 10740 | 11236 | 11732 |

TABLE 20-continued provides the sequence identifiers for the light chain, heavy chain, and CDRs of the indicated clones

| Antibody Clone Number | SEQ ID NO | | | | | | | |
|---|---|---|---|---|---|---|---|---|
| | Light Chain | Heavy Chain | CDR1 (Light) | CDR2 (Light) | CDR3 (Light) | CDR1 (Heavy) | CDR2 (Heavy) | CDR3 (Heavy) |
| 262 | 8261 | 8757 | 9253 | 9749 | 10245 | 10741 | 11237 | 11733 |
| 263 | 8262 | 8758 | 9254 | 9750 | 10246 | 10742 | 11238 | 11734 |
| 264 | 8263 | 8759 | 9255 | 9751 | 10247 | 10743 | 11239 | 11735 |
| 265 | 8264 | 8760 | 9256 | 9752 | 10248 | 10744 | 11240 | 11736 |
| 266 | 8265 | 8761 | 9257 | 9753 | 10249 | 10745 | 11241 | 11737 |
| 267 | 8266 | 8762 | 9258 | 9754 | 10250 | 10746 | 11242 | 11738 |
| 268 | 8267 | 8763 | 9259 | 9755 | 10251 | 10747 | 11243 | 11739 |
| 269 | 8268 | 8764 | 9260 | 9756 | 10252 | 10748 | 11244 | 11740 |
| 270 | 8269 | 8765 | 9261 | 9757 | 10253 | 10749 | 11245 | 11741 |
| 271 | 8270 | 8766 | 9262 | 9758 | 10254 | 10750 | 11246 | 11742 |
| 272 | 8271 | 8767 | 9263 | 9759 | 10255 | 10751 | 11247 | 11743 |
| 273 | 8272 | 8768 | 9264 | 9760 | 10256 | 10752 | 11248 | 11744 |
| 274 | 8273 | 8769 | 9265 | 9761 | 10257 | 10753 | 11249 | 11745 |
| 275 | 8274 | 8770 | 9266 | 9762 | 10258 | 10754 | 11250 | 11746 |
| 276 | 8275 | 8771 | 9267 | 9763 | 10259 | 10755 | 11251 | 11747 |
| 277 | 8276 | 8772 | 9268 | 9764 | 10260 | 10756 | 11252 | 11748 |
| 278 | 8277 | 8773 | 9269 | 9765 | 10261 | 10757 | 11253 | 11749 |
| 279 | 8278 | 8774 | 9270 | 9766 | 10262 | 10758 | 11254 | 11750 |
| 280 | 8279 | 8775 | 9271 | 9767 | 10263 | 10759 | 11255 | 11751 |
| 281 | 8280 | 8776 | 9272 | 9768 | 10264 | 10760 | 11256 | 11752 |
| 282 | 8281 | 8777 | 9273 | 9769 | 10265 | 10761 | 11257 | 11753 |
| 283 | 8282 | 8778 | 9274 | 9770 | 10266 | 10762 | 11258 | 11754 |
| 284 | 8283 | 8779 | 9275 | 9771 | 10267 | 10763 | 11259 | 11755 |
| 285 | 8284 | 8780 | 9276 | 9772 | 10268 | 10764 | 11260 | 11756 |
| 286 | 8285 | 8781 | 9277 | 9773 | 10269 | 10765 | 11261 | 11757 |
| 287 | 8286 | 8782 | 9278 | 9774 | 10270 | 10766 | 11262 | 11758 |
| 288 | 8287 | 8783 | 9279 | 9775 | 10271 | 10767 | 11263 | 11759 |
| 289 | 8288 | 8784 | 9280 | 9776 | 10272 | 10768 | 11264 | 11760 |
| 290 | 8289 | 8785 | 9281 | 9777 | 10273 | 10769 | 11265 | 11761 |
| 291 | 8290 | 8786 | 9282 | 9778 | 10274 | 10770 | 11266 | 11762 |
| 292 | 8291 | 8787 | 9283 | 9779 | 10275 | 10771 | 11267 | 11763 |
| 293 | 8292 | 8788 | 9284 | 9780 | 10276 | 10772 | 11268 | 11764 |
| 294 | 8293 | 8789 | 9285 | 9781 | 10277 | 10773 | 11269 | 11765 |
| 295 | 8294 | 8790 | 9286 | 9782 | 10278 | 10774 | 11270 | 11766 |
| 296 | 8295 | 8791 | 9287 | 9783 | 10279 | 10775 | 11271 | 1176 |
| 297 | 8296 | 8792 | 9288 | 9784 | 10280 | 10776 | 11272 | 11768 |
| 298 | 8297 | 8793 | 9289 | 9785 | 10281 | 10777 | 11273 | 11769 |
| 299 | 8298 | 8794 | 9290 | 9786 | 10282 | 10778 | 11274 | 11770 |
| 300 | 8299 | 8795 | 9291 | 9787 | 10283 | 10779 | 11275 | 11771 |
| 301 | 8300 | 8796 | 9292 | 9788 | 10284 | 10780 | 11276 | 11772 |
| 302 | 8301 | 8797 | 9293 | 9789 | 10285 | 10781 | 11277 | 11773 |
| 303 | 8302 | 8798 | 9294 | 9790 | 10286 | 10782 | 11278 | 11774 |
| 304 | 8303 | 8799 | 9295 | 9791 | 10287 | 10783 | 11279 | 11775 |
| 305 | 8304 | 8800 | 9296 | 9792 | 10288 | 10784 | 11280 | 11776 |
| 306 | 8305 | 8801 | 9297 | 9793 | 10289 | 10785 | 11281 | 11777 |
| 307 | 8306 | 8802 | 9298 | 9794 | 10290 | 10786 | 11282 | 11778 |
| 308 | 8307 | 8803 | 9299 | 9795 | 10291 | 10787 | 11283 | 11779 |
| 309 | 8308 | 8804 | 9300 | 9796 | 10292 | 10788 | 11284 | 11780 |
| 310 | 8309 | 8805 | 9301 | 9797 | 10293 | 10789 | 11285 | 11781 |
| 311 | 8310 | 8806 | 9302 | 9798 | 10294 | 10790 | 11286 | 11782 |
| 312 | 8311 | 8807 | 9303 | 9799 | 10295 | 10791 | 11287 | 11783 |
| 313 | 8312 | 8808 | 9304 | 9800 | 10296 | 10792 | 11288 | 11784 |
| 314 | 8313 | 8809 | 9305 | 9801 | 10297 | 10793 | 11289 | 11785 |
| 315 | 8314 | 8810 | 9306 | 9802 | 10298 | 10794 | 11290 | 11786 |
| 316 | 8315 | 8811 | 9307 | 9803 | 10299 | 10795 | 11291 | 11787 |
| 317 | 8316 | 8812 | 9308 | 9804 | 10300 | 10796 | 11292 | 11788 |
| 318 | 8317 | 8813 | 9309 | 9805 | 10301 | 10797 | 11293 | 11789 |
| 319 | 8318 | 8814 | 9310 | 9806 | 10302 | 10798 | 11294 | 11790 |
| 320 | 8319 | 8815 | 9311 | 9807 | 10303 | 10799 | 11295 | 11791 |
| 321 | 8320 | 8816 | 9312 | 9808 | 10304 | 10800 | 11296 | 11792 |
| 322 | 8321 | 8817 | 9313 | 9809 | 10305 | 10801 | 11297 | 11793 |
| 323 | 8322 | 8818 | 9314 | 9810 | 10306 | 10802 | 11298 | 11794 |
| 324 | 8323 | 8819 | 9315 | 9811 | 10307 | 10803 | 11299 | 11795 |
| 325 | 8324 | 8820 | 9316 | 9812 | 10308 | 10804 | 11300 | 11796 |
| 326 | 8325 | 8821 | 9317 | 9813 | 10309 | 10805 | 11301 | 11797 |
| 327 | 8326 | 8822 | 9318 | 9814 | 10310 | 10806 | 11302 | 11798 |
| 328 | 8327 | 8823 | 9319 | 9815 | 10311 | 10807 | 11303 | 11799 |
| 329 | 8328 | 8824 | 9320 | 9816 | 10312 | 10808 | 11304 | 11800 |
| 330 | 8329 | 8825 | 9321 | 9817 | 10313 | 10809 | 11305 | 11801 |
| 331 | 8330 | 8826 | 9322 | 9818 | 10314 | 10810 | 11306 | 11802 |
| 332 | 8331 | 8827 | 9323 | 9819 | 10315 | 10811 | 11307 | 11803 |
| 333 | 8332 | 8828 | 9324 | 9820 | 10316 | 10812 | 11308 | 11804 |
| 334 | 8333 | 8829 | 9325 | 9821 | 10317 | 10813 | 11309 | 11805 |

TABLE 20-continued provides the sequence identifiers for the light chain, heavy chain, and CDRs of the indicated clones

| Antibody Clone Number | SEQ ID NO | | | | | | | |
|---|---|---|---|---|---|---|---|---|
| | Light Chain | Heavy Chain | CDR1 (Light) | CDR2 (Light) | CDR3 (Light) | CDR1 (Heavy) | CDR2 (Heavy) | CDR3 (Heavy) |
| 335 | 8334 | 8830 | 9326 | 9822 | 10318 | 10814 | 11310 | 11806 |
| 336 | 8335 | 8831 | 9327 | 9823 | 10319 | 10815 | 11311 | 11807 |
| 337 | 8336 | 8832 | 9328 | 9824 | 10320 | 10816 | 11312 | 11808 |
| 338 | 8337 | 8833 | 9329 | 9825 | 10321 | 10817 | 11313 | 11809 |
| 339 | 8338 | 8834 | 9330 | 9826 | 10322 | 10818 | 11314 | 11810 |
| 340 | 8339 | 8835 | 9331 | 9827 | 10323 | 10819 | 11315 | 11811 |
| 341 | 8340 | 8836 | 9332 | 9828 | 10324 | 10820 | 11316 | 11812 |
| 342 | 8341 | 8837 | 9333 | 9829 | 10325 | 10821 | 11317 | 11813 |
| 343 | 8342 | 8838 | 9334 | 9830 | 10326 | 10822 | 11318 | 11814 |
| 344 | 8343 | 8839 | 9335 | 9831 | 10327 | 10823 | 11319 | 11815 |
| 345 | 8344 | 8840 | 9336 | 9832 | 10328 | 10824 | 11320 | 11816 |
| 346 | 8345 | 8841 | 9337 | 9833 | 10329 | 10825 | 11321 | 11817 |
| 347 | 8346 | 8842 | 9338 | 9834 | 10330 | 10826 | 11322 | 11818 |
| 348 | 8347 | 8843 | 9339 | 9835 | 10331 | 10827 | 11323 | 11819 |
| 349 | 8348 | 8844 | 9340 | 9836 | 10332 | 10828 | 11324 | 11820 |
| 350 | 8349 | 8845 | 9341 | 9837 | 10333 | 10829 | 11325 | 11821 |
| 351 | 8350 | 8846 | 9342 | 9838 | 10334 | 10830 | 11326 | 11822 |
| 352 | 8351 | 8847 | 9343 | 9839 | 10335 | 10831 | 11327 | 11823 |
| 353 | 8352 | 8848 | 9344 | 9840 | 10336 | 10832 | 11328 | 11824 |
| 354 | 8353 | 8849 | 9345 | 9841 | 10337 | 10833 | 11329 | 11825 |
| 355 | 8354 | 8850 | 9346 | 9842 | 10338 | 10834 | 11330 | 11826 |
| 356 | 8355 | 8851 | 9347 | 9843 | 10339 | 10835 | 11331 | 11827 |
| 357 | 8356 | 8852 | 9348 | 9844 | 10340 | 10836 | 11332 | 11828 |
| 358 | 8357 | 8853 | 9349 | 9845 | 10341 | 10837 | 11333 | 11829 |
| 359 | 8358 | 8854 | 9350 | 9846 | 10342 | 10838 | 11334 | 11830 |
| 360 | 8359 | 8855 | 9351 | 9847 | 10343 | 10839 | 11335 | 11831 |
| 361 | 8360 | 8856 | 9352 | 9848 | 10344 | 10840 | 11336 | 11832 |
| 362 | 8361 | 8857 | 9353 | 9849 | 10345 | 10841 | 11337 | 11833 |
| 363 | 8362 | 8858 | 9354 | 9850 | 10346 | 10842 | 11338 | 11834 |
| 364 | 8363 | 8859 | 9355 | 9851 | 10347 | 10843 | 11339 | 11835 |
| 365 | 8364 | 8860 | 9356 | 9852 | 10348 | 10844 | 11340 | 11836 |
| 366 | 8365 | 8861 | 9357 | 9853 | 10349 | 10845 | 11341 | 11837 |
| 367 | 8366 | 8862 | 9358 | 9854 | 10350 | 10846 | 11342 | 11838 |
| 368 | 8367 | 8863 | 9359 | 9855 | 10351 | 10847 | 11343 | 11839 |
| 369 | 8368 | 8864 | 9360 | 9856 | 10352 | 10848 | 11344 | 11840 |
| 370 | 8369 | 8865 | 9361 | 9857 | 10353 | 10849 | 11345 | 11841 |
| 371 | 8370 | 8866 | 9362 | 9858 | 10354 | 10850 | 11346 | 11842 |
| 372 | 8371 | 8867 | 9363 | 9859 | 10355 | 10851 | 11347 | 11843 |
| 373 | 8372 | 8868 | 9364 | 9860 | 10356 | 10852 | 11348 | 11844 |
| 374 | 8373 | 8869 | 9365 | 9861 | 10357 | 10853 | 11349 | 11845 |
| 375 | 8374 | 8870 | 9366 | 9862 | 10358 | 10854 | 11350 | 11846 |
| 376 | 8375 | 8871 | 9367 | 9863 | 10359 | 10855 | 11351 | 11847 |
| 377 | 8376 | 8872 | 9368 | 9864 | 10360 | 10856 | 11352 | 11848 |
| 378 | 8377 | 8873 | 9369 | 9865 | 10361 | 10857 | 11353 | 11849 |
| 379 | 8378 | 8874 | 9370 | 9866 | 10362 | 10858 | 11354 | 11850 |
| 380 | 8379 | 8875 | 9371 | 9867 | 10363 | 10859 | 11355 | 11851 |
| 381 | 8380 | 8876 | 9372 | 9868 | 10364 | 10860 | 11356 | 11852 |
| 382 | 8381 | 8877 | 9373 | 9869 | 10365 | 10861 | 11357 | 11853 |
| 383 | 8382 | 8878 | 9374 | 9870 | 10366 | 10862 | 11358 | 11854 |
| 384 | 8383 | 8879 | 9375 | 9871 | 10367 | 10863 | 11359 | 11855 |
| 385 | 8384 | 8880 | 9376 | 9872 | 10368 | 10864 | 11360 | 11856 |
| 386 | 8385 | 8881 | 9377 | 9873 | 10369 | 10865 | 11361 | 11857 |
| 387 | 8386 | 8882 | 9378 | 9874 | 10370 | 10866 | 11362 | 11858 |
| 388 | 8387 | 8883 | 9379 | 9875 | 10371 | 10867 | 11363 | 11859 |
| 389 | 8388 | 8884 | 9380 | 9876 | 10372 | 10868 | 11364 | 11860 |
| 390 | 8389 | 8885 | 9381 | 9877 | 10373 | 10869 | 11365 | 11861 |
| 391 | 8390 | 8886 | 9382 | 9878 | 10374 | 10870 | 11366 | 11862 |
| 392 | 8391 | 8887 | 9383 | 9879 | 10375 | 10871 | 11367 | 11863 |
| 393 | 8392 | 8888 | 9384 | 9880 | 10376 | 10872 | 11368 | 11864 |
| 394 | 8393 | 8889 | 9385 | 9881 | 10377 | 10873 | 11369 | 11865 |
| 395 | 8394 | 8890 | 9386 | 9882 | 10378 | 10874 | 11370 | 11866 |
| 396 | 8395 | 8891 | 9387 | 9883 | 10379 | 10875 | 11371 | 11867 |
| 397 | 8396 | 8892 | 9388 | 9884 | 10380 | 10876 | 11372 | 11868 |
| 398 | 8397 | 8893 | 9389 | 9885 | 10381 | 10877 | 11373 | 11869 |
| 399 | 8398 | 8894 | 9390 | 9886 | 10382 | 10878 | 11374 | 11870 |
| 400 | 8399 | 8895 | 9391 | 9887 | 10383 | 10879 | 11375 | 11871 |
| 401 | 8400 | 8896 | 9392 | 9888 | 10384 | 10880 | 11376 | 11872 |
| 402 | 8401 | 8897 | 9393 | 9889 | 10385 | 10881 | 11377 | 11873 |
| 403 | 8402 | 8898 | 9394 | 9890 | 10386 | 10882 | 11378 | 11874 |
| 404 | 8403 | 8899 | 9395 | 9891 | 10387 | 10883 | 11379 | 11875 |
| 405 | 8404 | 8900 | 9396 | 9892 | 10388 | 10884 | 11380 | 11876 |
| 406 | 8405 | 8901 | 9397 | 9893 | 10389 | 10885 | 11381 | 11877 |
| 407 | 8406 | 8902 | 9398 | 9894 | 10390 | 10886 | 11382 | 11878 |

TABLE 20-continued provides the sequence identifiers for the light chain, heavy chain, and CDRs of the indicated clones

| Antibody Clone Number | SEQ ID NO | | | | | | | |
|---|---|---|---|---|---|---|---|---|
| | Light Chain | Heavy Chain | CDR1 (Light) | CDR2 (Light) | CDR3 (Light) | CDR1 (Heavy) | CDR2 (Heavy) | CDR3 (Heavy) |
| 408 | 8407 | 8903 | 9399 | 9895 | 10391 | 10887 | 11383 | 11879 |
| 409 | 8408 | 8904 | 9400 | 9896 | 10392 | 10888 | 11384 | 11880 |
| 410 | 8409 | 8905 | 9401 | 9897 | 10393 | 10889 | 11385 | 11881 |
| 411 | 8410 | 8906 | 9402 | 9898 | 10394 | 10890 | 11386 | 11882 |
| 412 | 8411 | 8907 | 9403 | 9899 | 10395 | 10891 | 11387 | 11883 |
| 413 | 8412 | 8908 | 9404 | 9900 | 10396 | 10892 | 11388 | 11884 |
| 414 | 8413 | 8909 | 9405 | 9901 | 10397 | 10893 | 11389 | 11885 |
| 415 | 8414 | 8910 | 9406 | 9902 | 10398 | 10894 | 11390 | 11886 |
| 416 | 8415 | 8911 | 9407 | 9903 | 10399 | 10895 | 11391 | 11887 |
| 417 | 8416 | 8912 | 9408 | 9904 | 10400 | 10896 | 11392 | 11888 |
| 418 | 8417 | 8913 | 9409 | 9905 | 10401 | 10897 | 11393 | 11889 |
| 419 | 8418 | 8914 | 9410 | 9906 | 10402 | 10898 | 11394 | 11890 |
| 420 | 8419 | 8915 | 9411 | 9907 | 10403 | 10899 | 11395 | 11891 |
| 421 | 8420 | 8916 | 9412 | 9908 | 10404 | 10900 | 11396 | 11892 |
| 422 | 8421 | 8917 | 9413 | 9909 | 10405 | 10901 | 11397 | 11893 |
| 423 | 8422 | 8918 | 9414 | 9910 | 10406 | 10902 | 11398 | 11894 |
| 424 | 8423 | 8919 | 9415 | 9911 | 10407 | 10903 | 11399 | 11895 |
| 425 | 8424 | 8920 | 9416 | 9912 | 10408 | 10904 | 11400 | 11896 |
| 426 | 8425 | 8921 | 9417 | 9913 | 10409 | 10905 | 11401 | 11897 |
| 427 | 8426 | 8922 | 9418 | 9914 | 10410 | 10906 | 11402 | 11898 |
| 428 | 8427 | 8923 | 9419 | 9915 | 10411 | 10907 | 11403 | 11899 |
| 429 | 8428 | 8924 | 9420 | 9916 | 10412 | 10908 | 11404 | 11900 |
| 430 | 8429 | 8925 | 9421 | 9917 | 10413 | 10909 | 11405 | 11901 |
| 431 | 8430 | 8926 | 9422 | 9918 | 10414 | 10910 | 11406 | 11902 |
| 432 | 8431 | 8927 | 9423 | 9919 | 10415 | 10911 | 11407 | 11903 |
| 433 | 8432 | 8928 | 9424 | 9920 | 10416 | 10912 | 11408 | 11904 |
| 434 | 8433 | 8929 | 9425 | 9921 | 10417 | 10913 | 11409 | 11905 |
| 435 | 8434 | 8930 | 9426 | 9922 | 10418 | 10914 | 11410 | 11906 |
| 436 | 8435 | 8931 | 9427 | 9923 | 10419 | 10915 | 11411 | 11907 |
| 437 | 8436 | 8932 | 9428 | 9924 | 10420 | 10916 | 11412 | 11908 |
| 438 | 8437 | 8933 | 9429 | 9925 | 10421 | 10917 | 11413 | 11909 |
| 439 | 8438 | 8934 | 9430 | 9926 | 10422 | 10918 | 11414 | 11910 |
| 440 | 8439 | 8935 | 9431 | 9927 | 10423 | 10919 | 11415 | 11911 |
| 441 | 8440 | 8936 | 9432 | 9928 | 10424 | 10920 | 11416 | 11912 |
| 442 | 8441 | 8937 | 9433 | 9929 | 10425 | 10921 | 11417 | 11913 |
| 443 | 8442 | 8938 | 9434 | 9930 | 10426 | 10922 | 11418 | 11914 |
| 444 | 8443 | 8939 | 9435 | 9931 | 10427 | 10923 | 11419 | 11915 |
| 445 | 8444 | 8940 | 9436 | 9932 | 10428 | 10924 | 11420 | 11916 |
| 446 | 8445 | 8941 | 9437 | 9933 | 10429 | 10925 | 11421 | 11917 |
| 447 | 8446 | 8942 | 9438 | 9934 | 10430 | 10926 | 11422 | 11918 |
| 448 | 8447 | 8943 | 9439 | 9935 | 10431 | 10927 | 11423 | 11919 |
| 449 | 8448 | 8944 | 9440 | 9936 | 10432 | 10928 | 11424 | 11920 |
| 450 | 8449 | 8945 | 9441 | 9937 | 10433 | 10929 | 11425 | 11921 |
| 451 | 8450 | 8946 | 9442 | 9938 | 10434 | 10930 | 11426 | 11922 |
| 452 | 8451 | 8947 | 9443 | 9939 | 10435 | 10931 | 11427 | 11923 |
| 453 | 8452 | 8948 | 9444 | 9940 | 10436 | 10932 | 11428 | 11924 |
| 454 | 8453 | 8949 | 9445 | 9941 | 10437 | 10933 | 11429 | 11925 |
| 455 | 8454 | 8950 | 9446 | 9942 | 10438 | 10934 | 11430 | 11926 |
| 456 | 8455 | 8951 | 9447 | 9943 | 10439 | 10935 | 11431 | 11927 |
| 457 | 8456 | 8952 | 9448 | 9944 | 10440 | 10936 | 11432 | 11928 |
| 458 | 8457 | 8953 | 9449 | 9945 | 10441 | 10937 | 11433 | 11929 |
| 459 | 8458 | 8954 | 9450 | 9946 | 10442 | 10938 | 11434 | 11930 |
| 460 | 8459 | 8955 | 9451 | 9947 | 10443 | 10939 | 11435 | 11931 |
| 461 | 8460 | 8956 | 9452 | 9948 | 10444 | 10940 | 11436 | 11932 |
| 462 | 8461 | 8957 | 9453 | 9949 | 10445 | 10941 | 11437 | 11933 |
| 463 | 8462 | 8958 | 9454 | 9950 | 10446 | 10942 | 11438 | 11934 |
| 464 | 8463 | 8959 | 9455 | 9951 | 10447 | 10943 | 11439 | 11935 |
| 465 | 8464 | 8960 | 9456 | 9952 | 10448 | 10944 | 11440 | 11936 |
| 466 | 8465 | 8961 | 9457 | 9953 | 10449 | 10945 | 11441 | 11937 |
| 467 | 8466 | 8962 | 9458 | 9954 | 10450 | 10946 | 11442 | 11938 |
| 468 | 8467 | 8963 | 9459 | 9955 | 10451 | 10947 | 11443 | 11939 |
| 469 | 8468 | 8964 | 9460 | 9956 | 10452 | 10948 | 11444 | 11940 |
| 470 | 8469 | 8965 | 9461 | 9957 | 10453 | 10949 | 11445 | 11941 |
| 471 | 8470 | 8966 | 9462 | 9958 | 10454 | 10950 | 11446 | 11942 |
| 472 | 8471 | 8967 | 9463 | 9959 | 10455 | 10951 | 11447 | 11943 |
| 473 | 8472 | 8968 | 9464 | 9960 | 10456 | 10952 | 11448 | 11944 |
| 474 | 8473 | 8969 | 9465 | 9961 | 10457 | 10953 | 11449 | 11945 |
| 475 | 8474 | 8970 | 9466 | 9962 | 10458 | 10954 | 11450 | 11946 |
| 476 | 8475 | 8971 | 9467 | 9963 | 10459 | 10955 | 11451 | 11947 |
| 477 | 8476 | 8972 | 9468 | 9964 | 10460 | 10956 | 11452 | 11948 |
| 478 | 8477 | 8973 | 9469 | 9965 | 10461 | 10957 | 11453 | 11949 |
| 479 | 8478 | 8974 | 9470 | 9966 | 10462 | 10958 | 11454 | 11950 |
| 480 | 8479 | 8975 | 9471 | 9967 | 10463 | 10959 | 11455 | 11951 |

TABLE 20-continued provides the sequence identifiers for the light chain, heavy chain, and CDRs of the indicated clones

| Antibody | SEQ ID NO | | | | | | | |
|---|---|---|---|---|---|---|---|---|
| Clone Number | Light Chain | Heavy Chain | CDR1 (Light) | CDR2 (Light) | CDR3 (Light) | CDR1 (Heavy) | CDR2 (Heavy) | CDR3 (Heavy) |
| 481 | 8480 | 8976 | 9472 | 9968 | 10464 | 10960 | 11456 | 11952 |
| 482 | 8481 | 8977 | 9473 | 9969 | 10465 | 10961 | 11457 | 11953 |
| 483 | 8482 | 8978 | 9474 | 9970 | 10466 | 10962 | 11458 | 11954 |
| 484 | 8483 | 8979 | 9475 | 9971 | 10467 | 10963 | 11459 | 11955 |
| 485 | 8484 | 8980 | 9476 | 9972 | 10468 | 10964 | 11460 | 11956 |
| 486 | 8485 | 8981 | 9477 | 9973 | 10469 | 10965 | 11461 | 11957 |
| 487 | 8486 | 8982 | 9478 | 9974 | 10470 | 10966 | 11462 | 11958 |
| 488 | 8487 | 8983 | 9479 | 9975 | 10471 | 10967 | 11463 | 11959 |
| 489 | 8488 | 8984 | 9480 | 9976 | 10472 | 10968 | 11464 | 11960 |
| 490 | 8489 | 8985 | 9481 | 9977 | 10473 | 10969 | 11465 | 11961 |
| 491 | 8490 | 8986 | 9482 | 9978 | 10474 | 10970 | 11466 | 11962 |
| 492 | 8491 | 8987 | 9483 | 9979 | 10475 | 10971 | 11467 | 11963 |
| 493 | 8492 | 8988 | 9484 | 9980 | 10476 | 10972 | 11468 | 11964 |
| 494 | 8493 | 8989 | 9485 | 9981 | 10477 | 10973 | 11469 | 11965 |
| 495 | 8494 | 8990 | 9486 | 9982 | 10478 | 10974 | 11470 | 11966 |
| 496 | 8495 | 8991 | 9487 | 9983 | 10479 | 10975 | 11471 | 11967 |

SEQUENCE LISTING (11998 sequences)

SEQ ID NO: 1 - protein, 108 aa, Homo sapiens
EIVLTQSPGTLSLSPGEGATLSCRASQSFSSNYLAWYQQKPGQAPRLLIYGASSRATGIPDRFSGSGSGTDFTLTISRLEPEDFAVYYCQQYGTSPFTFGPGTKVDIK

SEQ ID NO: 2 - protein, 108 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGRSPFTFGPGTKVDIK

SEQ ID NO: 3 - protein, 108 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPFTFGPGTKVDIK

SEQ ID NO: 4 - protein, 108 aa, Homo sapiens
EIVLTQSPGTLSLSPGDRATLSCRASQSGSSSYLAWYQQKPGQAPRLLIYGASSRATGIPDRFSGSGSGTDFTLTISRLEPEDFAVYYCQQYGTSPFTSGPGTKVDIK

SEQ ID NO: 5 - protein, 108 aa, Homo sapiens; identical to SEQ ID NO: 4

SEQ ID NO: 6 - protein, 107 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQSYSTPFTFGPGTKVDIK

SEQ ID NO: 7 - protein, 108 aa, Homo sapiens; identical to SEQ ID NO: 3

SEQ ID NO: 8 - protein, 106 aa, Homo sapiens
EIVLTQSPGTLSLSPGERATLSCRASQSVSYLAWYQQKPGQAPRLLIYGASSRATGIPDRFSGSGSGTDFTLTISRLEPEDFAVYYCQQYGSSPWTFGQGTKVEIK

SEQ ID NO: 9 - protein, 107 aa, Homo sapiens; identical to SEQ ID NO: 6

SEQ ID NO: 10 - protein, 108 aa, Homo sapiens; identical to SEQ ID NO: 3

SEQ ID NO: 11 - protein, 107 aa, Homo sapiens
DIQLTQSPSFLSASVGDRVTITCRASQGISSYLAWYQQKPGKAPKLLIYAASTLQSGVPSRFSGSGSGTEFTLTISSLQPEDFATYYCQQLNSYPPTFGQGTKVEIK

SEQ ID NO: 12 - protein, 108 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGTSPWTFGQGTKVEIK

SEQ ID NO: 13 - protein, 108 aa, Homo sapiens; identical to SEQ ID NO: 3

SEQ ID NO: 14 - protein, 108 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTSGQGTKVEIK

SEQ ID NO: 15 - protein, 108 aa, Homo sapiens; identical to SEQ ID NO: 3

SEQ ID NO: 16 - protein, 107 aa, Homo sapiens
DIQMTQSPSSLSASVGDRVTITCRASQGISNYLAWYQQKPGKVPKLLIYAASTLQSGVPSRFSGSGSGTDFTLTISSLQPEDVATYYCQNYNSAPWTFGQGTKVEIK

SEQ ID NO: 17 - protein, 107 aa, Homo sapiens
DIQMTQSPSSLSASVGDRVTITCRASQAIRNDLGWYQQKPGKAPKRLIYAASSLQSGVPPRFSGSGSGTEFTLTISSLQPEDFATYYCLQHNSYPLTFGGGTKVEIK

SEQ ID NO: 18 - protein, 106 aa, Homo sapiens; identical to SEQ ID NO: 8

SEQ ID NO: 19 - protein, 109 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSSMYTFGQGTKLEIK

SEQ ID NO: 20 - protein, 108 aa, Homo sapiens; identical to SEQ ID NO: 2

SEQ ID NO: 21 - protein, 112 aa, Homo sapiens
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQTLQTPLTFGGGTKVEIK

SEQ ID NO: 22 - protein, 107 aa, Homo sapiens; identical to SEQ ID NO: 17

SEQ ID NO: 23 - protein, 108 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGPSPWTFGQGTKVEIK

SEQ ID NO: 24 - protein, 107 aa, Homo sapiens
DIQMTQSPSSLSASVGDRVTITCRASQSISSYLNWYQQKPGKAPKLLIYAASSLQSGVPSRFSGSGSGTDFTLTISSLQPEDFATYYCQQSYRTPFTFGPGTKVDIK

SEQ ID NO: 25 - protein, 108 aa, Homo sapiens
EIVMTQSPATLSLSPGERATLSCRASQSVSSSYLSWYQQKPGQAPRLLIYGASTRATGIPARFSGSGSGTDFTLTISNLQPEDFAVYYCQQGYNLPFTAGPGTKVDIK

SEQ ID NO: 26 - protein, 112 aa, Homo sapiens
DVVMTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPITSGQGTRLEIK

SEQ ID NO: 27 - protein, 108 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYHCQQYGRSPWTLGQGTKVEIK

SEQ ID NO: 28 - protein, 108 aa, Homo sapiens; identical to SEQ ID NO: 14

SEQ ID NO: 29-100 - skipped (72 entries)

SEQ ID NO: 101 - protein, 120 aa, Homo sapiens
QVQLVESGGGVVQPGRSLRLSCAASGFTFSSFGMHWVRQAPGKGLEWVAVIWYDGRNKYYVDSVKGRFTISRDNSNNTLYLQMNSLRAEDTAVYYCARGEFFGEFFDYWGQGTLVTVSSA

SEQ ID NO: 102 - protein, 120 aa, Homo sapiens
QVQLVESGGGVVQPGRSLRLSCAASGFTFSNYGMNWVRQAPGKGLEWVAVIWYDGRNKHYADSVKGRFTISRDNSKNTLYLQMNSLRAEDTAVYYCARGGDWGPYFDYWGQGTLVTVSSA

SEQ ID NO: 103 - protein, 120 aa, Homo sapiens
QVQLVESGGGVVQPGRSLRLSCIASGFTFSSYGMHWVRQAPGKGLEWVAVNWYDGSNKHYADSVKGRFTISRDNSKNTLYLQMNSLRAEDTAVYYCARGGVWGPYFDYWGQGTLVTVSSA

SEQ ID NO: 104 - protein, 119 aa, Homo sapiens
QVQLVESGGGVVQPGRSLRISCAASGFTFSSYGIHWVRQAPGKGLQWVAVIWYDGRNKYYADSVKGRFTISRDNSKNTLYLQMNSLRAEDTAVYYCSRSGSFGAFDIWGQGTMVTVSSA

SEQ ID NO: 105 - protein, 121 aa, Homo sapiens
QVQLVESGGGVVQPGRSLRLSCAASGFTFSSYGMHWVRQAPGKGLEWVAVIWYDGNNKYYADSVKGRFTISRDNSKNTLYLQMYSLRAEDTAVYYCARGGILAAGIFDYWGQGTLVTVSSA

SEQ ID NO: 106 - protein, 124 aa, Homo sapiens
QVQLVESGGGVVQPGRSLRLSCAASGFTFSSYGMHWVRQAPGKGLEWVAVIWYDGSYKYYADSVKGRFTISRDDSKNTLYLQMSSLRAEDTAVYYCARAPHYAILTGYYEDYWGQGTLVTVSSA

SEQ ID NO: 107 - protein, 119 aa, Homo sapiens
QVQLVESGGGVVQPGRSLRLSCAASGFTLSSFGMHWVRQAPGKGLEWVAVIWYDGSNKYYADSVKGRFIISRDNSKTALYLQMNSLRAEDTAVYYCARAHYFGAFDIWGQGTMVTVSSA

SEQ ID NO: 108 - protein, 119 aa, Homo sapiens
QVQLVESGGGVVQPGRSLRLSCAASGFTFSRYGMHWVRQAPGKGLEWVAVIWYDGRNKYYADSVKGRFTISRDNSKNTLYLQMNSLRAEDTALYSCARAGELGPFDYWGQGTLVTVSSA

SEQ ID NO: 109 - protein, 120 aa, Homo sapiens
QVQLVESGGGVVQPGRSLRLSCAASGFTFSSHGMHWVRQAPGKGLEWVAVIWYDGSNKHYADSVKGRFTISRDNSKNTLYLQMNSLRAEDTAVYYCARGDILTGYYGYWGQGTLVTVSSA

SEQ ID NO: 110 - protein, 119 aa, Homo sapiens
QVQLVESGGGVVQPGRSLRLSCVASGFTLSSYGMHWVRQAPGKGLEWVAVIWYDGSNKHYADSVKGRFTISRDNSKNTLSLQMNSLRAEDTAVYYCARGGQLGPFDYWGQGTLVTVSSA

SEQ ID NO: 111 - protein, 123 aa, Homo sapiens
QVQLVESGGGVVQPGRSLRLSCAASGFTFSSYGMHWVRQAPGKGLEWVAVIWYDVGNKYYIDSVKGRFTISRDNSKNTLYLQMNSLRAEDTAVYYCARDYYGSGSPRHFDYWGQGTLVTVSSA

SEQ ID NO: 112 - protein, 119 aa, Homo sapiens
QVQLVESGGGVVQPGRSLRLSCAASGFTFSSYGMHWVRQAPGKGLEWVAVIWYDGSNKYYADSVKGRFTFSRDNSKNTLYLQMNSLRAEDTAVYYCARGGLMGAFDYWGQGTLVTVSSA

SEQ ID NO: 113 - protein, 120 aa, Homo sapiens
QVQLVESGGGVVQPGRSLRLSCAASGFTFSSYGMHWVRQAPGKGLEWVAVIWYDGRNKDYADSVKGRITISRDNSKNTLYLQMNSLRAEDTAVYYCARGGLLGPYFDYWGQGTLVTVSSA

SEQ ID NO: 114 - protein, 119 aa, Homo sapiens
QVQLVESGGGVVQPGRSLRLSCAASGFTFSSYGMHWVRQAPGTGLEWVAVIWYEGRNKYYADPVKGRFTISRDNSKNTLYLQMNSLRDDDTAVYYCARAGDLGAFDIWGQGTMVTVSSA

SEQ ID NO: 115 - protein, 119 aa, Homo sapiens
QVQLVESGGGVVQPGRSLRLSCAASGFTFRSYGMHWVRQAPGKGLEWVAVIWYDGSNKHYADSVKGRFTISRDNSKNTLYLQMNSLRAEDTAVYYCARNGLIGAFDIWGQGTMVTVSSA

SEQ ID NO: 116 - protein, 119 aa, Homo sapiens
QVQLVESGGGVVQPGRSLRLSCAASGFTFSSYGIHWVRQAPGKGLEWVAVIWYDGSNKYYADSVKGRFTISRDNSKNTLYLQMNSLRAEDTAVYYCARGSLLGPFDYWGQGTLVTVSSA

SEQ ID NO: 117 - protein, 119 aa, Homo sapiens
EVQLVESGGGLVQPGGSLRLSCAASGFTFSNYAMSWVRQAPGKGLEWVSAISGGGLSTYYADSVKGRFTISRDNSKNTLYLQMNSLRAEDTAVYYCAKDLLWLGFDYWGQGTLVTVSSA

SEQ ID NO: 118 - protein, 119 aa, Homo sapiens
QVQLVESGGGVVQPGRSLRLSCAASGFTFSSYGMHWVRQAPGKGLEWVAVIWYDGSNKFYADSVKGRFTISSDNSKNTLYLQMNSLRAEDTAVYYCARGGHLGSFDYWGQGTLVTVSSA

SEQ ID NO: 119 - protein, 124 aa, Homo sapiens
QVQLVQSGAEVKKPGASVKVSCKASGYTFTSYYMHWVRQAPGQGLEWMGIINPSVGSTSYAQKFQGRVTMTRDTSTSTVYMELSSLRSEDTAVYYCAREVRVRGVIIPFFDYWDQGTLVTVSSA

SEQ ID NO: 120 - protein, 117 aa, Homo sapiens
QVQLVQSGAEVKKPGASVKVSCKASGYTFTSYGISWVRQAPGQGLEWMGWISAYNGNTNYAQKFQGRVTMTTDTSTSTAYMELRSLRSDDTAVYYCAKVSGYFDYWGQGTLVTVSSA

SEQ ID NO: 121 - protein, 123 aa, Homo sapiens
QVQLVESGGGVVQPGRSLRLSCAASGFTFSSYGMHWVRQAPGKGLEWVAVIWYDGNNKYYADSVKGRFTISRDNSKNTLYLHMNSLRADDTAVYYCARMLRGAPYYYGMDVWGQGTTVTVSSA

SEQ ID NO: 122 - protein, 119 aa, Homo sapiens
EVQLVESGGGLVQPGGSLRLSCAASGFTFSSYAMSWVRQAPGKGLEWVSGISGSGGSTYYADSVKGRFTISRDNSKNTLYLQMNSLRAEDTAVYYCAKLGIAWYFDVWGRGTLVTVSSA

SEQ ID NO: 123 - protein, 119 aa, Homo sapiens
QVQLVQSGAEVKKPGASVKVSCKASGYTFTSYGISWVRQAPGQGLEWMGWISAYNGNTYYAQKFQGRVTMTTDTSTSTAYVELRSLRSDDTAVYYCARVTGRDAFDIWGQGTMVTVSSA

SEQ ID NO: 124 - protein, 118 aa, Homo sapiens
QVQLVQSGAEVKKPGASVKVSCKASGYTFTSYGISWVRQAPGQGLECMGWISAYNGNTNYAQKFQGRVTMITDTSTSTAYMELRSLRSDDTAVYYCARVGPINLDYWGQGTLVTVSSA

SEQ ID NO: 125 - protein, 118 aa, Homo sapiens
QVQLVQSGAEVKKPGASVKVSCKASGYTFTNYGISWVRQAPGQGLEWMGWISVYNGNTNYAQKFQGRVTMTTDTSTSTAYMELRSLISDDTAVYYCARLGKGLFDYWGQGTLVTVSSA

SEQ ID NO: 126 - protein, 121 aa, Homo sapiens
QVQLVQSGAEVKKPGASVKVSCKASDYTFTYYGISWVRQAPGQGLEWMGWISAYNGNTNYAQKLQGRVTMTTDTSTNTAYLELRSLRSDDTAVYYCARDYYDSSGYFDYWGQGTLVTVSSA

SEQ ID NO: 127 - protein, 117 aa, Homo sapiens
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCGRWVRGVEYWGQGTLVTVSSA

SEQ ID NO: 128 - protein, 119 aa, Homo sapiens
QVQLVESGGGVVQPGRSLGLSCAASGFTFSTYGMHWVRQAPGKGLEWVAVTLYDGSNKYYADSVKGRFTISRDNSKNTLYLQMNSLRAEDTAVYYCARASLTGSFDYWGQGTLVTVSSA

SEQ ID NO: 129-1000 - skipped (872 entries)

SEQ ID NO: 1001 - protein, 7 aa, Homo sapiens
QSFSSNY

SEQ ID NO: 1002 - protein, 7 aa, Homo sapiens
QSVSSSY

SEQ ID NO: 1003 - protein, 7 aa, Homo sapiens
QSVSSSY

SEQ ID NO: 1004 - protein, 7 aa, Homo sapiens
QSGSSSY

SEQ ID NO: 1005 - protein, 7 aa, Homo sapiens
QSGSSSY

SEQ ID NO: 1006 - protein, 6 aa, Homo sapiens
QSISSY

SEQ ID NO: 1007 - protein, 7 aa, Homo sapiens
QSVSSSY

SEQ ID NO: 1008 - protein, 5 aa, Homo sapiens
QSVSY

SEQ ID NO: 1009 - protein, 6 aa, Homo sapiens
QSISSY

SEQ ID NO: 1010 - protein, 7 aa, Homo sapiens
QSVSSSY

SEQ ID NO: 1011 - protein, 6 aa, Homo sapiens
QGISSY

SEQ ID NO: 1012 - protein, 7 aa, Homo sapiens
QSVSSSY

SEQ ID NO: 1013 - protein, 7 aa, Homo sapiens
QSVSSSY

SEQ ID NO: 1014 - protein, 7 aa, Homo sapiens
QSVSSSY

SEQ ID NO: 1015 - protein, 7 aa, Homo sapiens
QSVSSSY

SEQ ID NO: 1016 - protein, 6 aa, Homo sapiens
QGISNY

SEQ ID NO: 1017 - protein, 6 aa, Homo sapiens
QAIRND

SEQ ID NO: 1018 - protein, 5 aa, Homo sapiens
QSVSY

SEQ ID NO: 1019 - protein, 7 aa, Homo sapiens
QSVSSSY

SEQ ID NO: 1020 - protein, 7 aa, Homo sapiens
QSVSSSY

SEQ ID NO: 1021 - protein, 11 aa, Homo sapiens
QSLLHSNGYNY

SEQ ID NO: 1022 - protein, 6 aa, Homo sapiens
QAIRND

SEQ ID NO: 1023 - protein, 7 aa, Homo sapiens
QSVSSSY

SEQ ID NO: 1024 - protein, 6 aa, Homo sapiens
QSISSY

SEQ ID NO: 1025 - protein, 7 aa, Homo sapiens
QSVSSSY

SEQ ID NO: 1026 - protein, 11 aa, Homo sapiens
QSLVYSDGNTY

SEQ ID NO: 1027 - protein, 7 aa, Homo sapiens
QSVSSSY

SEQ ID NO: 1028 - protein, 7 aa, Homo sapiens
QSVSSSY

SEQ ID NO: 1029-2000 - skipped (972 entries)

SEQ ID NO: 2001 - protein, 3 aa, Homo sapiens
GAS

SEQ ID NO: 2002 - protein, 3 aa, Homo sapiens
GAS

SEQ ID NO: 2003 - protein, 3 aa, Homo sapiens
GAS

SEQ ID NO: 2004 - protein, 3 aa, Homo sapiens
GAS

SEQ ID NO: 2005 - protein, 3 aa, Homo sapiens
GAS

SEQ ID NO: 2006 - protein, 3 aa, Homo sapiens
AAS

SEQ ID NO: 2007 - protein, 3 aa, Homo sapiens
GAS

SEQ ID NO: 2008 - protein, 3 aa, Homo sapiens
GAS

SEQ ID NO: 2009 - protein, 3 aa, Homo sapiens
AAS

SEQ ID NO: 2010 - protein, 3 aa, Homo sapiens
GAS

SEQ ID NO: 2011 - protein, 3 aa, Homo sapiens
AAS

SEQ ID NO: 2012 - protein, 3 aa, Homo sapiens
GAS

SEQ ID NO: 2013 - protein, 3 aa, Homo sapiens
GAS

SEQ ID NO: 2014 - protein, 3 aa, Homo sapiens
GAS

SEQ ID NO: 2015 - protein, 3 aa, Homo sapiens
GAS

SEQ ID NO: 2016 - protein, 3 aa, Homo sapiens
AAS

SEQ ID NO: 2017 - protein, 3 aa, Homo sapiens
AAS

SEQ ID NO: 2018 - protein, 3 aa, Homo sapiens
GAS

SEQ ID NO: 2019 - protein, 3 aa, Homo sapiens
GAS

SEQ ID NO: 2020 - protein, 3 aa, Homo sapiens
GAS

SEQ ID NO: 2021 - protein, 3 aa, Homo sapiens
LGS

SEQ ID NO: 2022 - protein, 3 aa, Homo sapiens
AAS

SEQ ID NO: 2023 - protein, 3 aa, Homo sapiens
GAS

SEQ ID NO: 2024 - protein, 3 aa, Homo sapiens
AAS

SEQ ID NO: 2025 - protein, 3 aa, Homo sapiens
GAS

SEQ ID NO: 2026 - protein, 3 aa, Homo sapiens
KVS

SEQ ID NO: 2027 - protein, 3 aa, Homo sapiens
GAS

SEQ ID NO: 2028 - protein, 3 aa, Homo sapiens
GAS

SEQ ID NO: 2029-3000 - skipped (972 entries)

SEQ ID NO: 3001 - protein, 9 aa, Homo sapiens
QQYGTSPFT

SEQ ID NO: 3002 - protein, 9 aa, Homo sapiens
QQYGRSPFT

SEQ ID NO: 3003 - protein, 9 aa, Homo sapiens
QQYGSSPFT

SEQ ID NO: 3004 - protein, 9 aa, Homo sapiens
QQYGTSPFT

SEQ ID NO: 3005 - protein, 9 aa, Homo sapiens
QQYGTSPFT

SEQ ID NO: 3006 - protein, 9 aa, Homo sapiens
QQSYSTPFT

SEQ ID NO: 3007 - protein, 9 aa, Homo sapiens
QQYGSSPFT

SEQ ID NO: 3008 - protein, 9 aa, Homo sapiens
QQYGSSPWT

SEQ ID NO: 3009 - protein, 9 aa, Homo sapiens
QQSYSTPFT

SEQ ID NO: 3010 - protein, 9 aa, Homo sapiens
QQYGSSPFT

SEQ ID NO: 3011 - protein, 9 aa, Homo sapiens
QQLNSYPPT

SEQ ID NO: 3012 - protein, 9 aa, Homo sapiens
QQYGTSPWT

SEQ ID NO: 3013 - protein, 9 aa, Homo sapiens
QQYGSSPFT

SEQ ID NO: 3014 - protein, 9 aa, Homo sapiens
QQYGSSPWT

SEQ ID NO: 3015 - protein, 9 aa, Homo sapiens
QQYGSSPFT

SEQ ID NO: 3016 - protein, 9 aa, Homo sapiens
QNYNSAPWT

SEQ ID NO: 3017 - protein, 9 aa, Homo sapiens
LQHNSYPLT

SEQ ID NO: 3018 - protein, 9 aa, Homo sapiens
QQYGSSPWT

SEQ ID NO: 3019 - protein, 10 aa, Homo sapiens
QQYGSSSMYT

SEQ ID NO: 3020 - protein, 9 aa, Homo sapiens
QQYGRSPFT

SEQ ID NO: 3021 - protein, 9 aa, Homo sapiens
MQTLQTPLT

SEQ ID NO: 3022 - protein, 9 aa, Homo sapiens
LQHNSYPLT

SEQ ID NO: 3023 - protein, 9 aa, Homo sapiens
QQYGPSPWT

SEQ ID NO: 3024 - protein, 9 aa, Homo sapiens
QQSYRTPFT

SEQ ID NO: 3025 - protein, 9 aa, Homo sapiens
QQGYNLPFT

SEQ ID NO: 3026 - protein, 9 aa, Homo sapiens
MQGTHWPIT

SEQ ID NO: 3027 - protein, 9 aa, Homo sapiens
QQYGRSPWT

SEQ ID NO: 3028 - protein, 9 aa, Homo sapiens
QQYGSSPWT

SEQ ID NO: 3029-4000 - skipped (972 entries)

SEQ ID NO: 4001 - protein, 8 aa, Homo sapiens
GFTFSSFG

SEQ ID NO: 4002 - protein, 8 aa, Homo sapiens
GFTFSNYG

SEQ ID NO: 4003 - protein, 8 aa, Homo sapiens
GFTFSSYG

SEQ ID NO: 4004 - protein, 8 aa, Homo sapiens
GFTFSSYG

SEQ ID NO: 4005 - protein, 8 aa, Homo sapiens
GFTFSSYG

SEQ ID NO: 4006 - protein, 8 aa, Homo sapiens
GFTFSSYG

SEQ ID NO: 4007 - protein, 8 aa, Homo sapiens
GFTLSSFG

SEQ ID NO: 4008 - protein, 8 aa, Homo sapiens
GFTFSRYG

SEQ ID NO: 4009 - protein, 8 aa, Homo sapiens
GFTFSSHG

SEQ ID NO: 4010 - protein, 8 aa, Homo sapiens
GFTLSSYG

SEQ ID NO: 4011 - protein, 8 aa, Homo sapiens
GFTFSSYG

SEQ ID NO: 4012 - protein, 8 aa, Homo sapiens
GFTFSSYG

SEQ ID NO: 4013 - protein, 8 aa, Homo sapiens
GFTFSSYG

SEQ ID NO: 4014 - protein, 8 aa, Homo sapiens
GFTFSSYG

SEQ ID NO: 4015 - protein, 8 aa, Homo sapiens
GFTFRSYG

SEQ ID NO: 4016 - protein, 8 aa, Homo sapiens
GFTFSSYG

SEQ ID NO: 4017 - protein, 8 aa, Homo sapiens
GFTFSNYA

SEQ ID NO: 4018 - protein, 8 aa, Homo sapiens
GFTFSSYG

SEQ ID NO: 4019 - protein, 8 aa, Homo sapiens
GYTFTSYY

SEQ ID NO: 4020 - protein, 8 aa, Homo sapiens
GYTFTSYG

SEQ ID NO: 4021 - protein, 8 aa, Homo sapiens
GFTFSSYG

SEQ ID NO: 4022 - protein, 8 aa, Homo sapiens
GFTFSSYA

SEQ ID NO: 4023 - protein, 8 aa, Homo sapiens
GYTFTSYG

SEQ ID NO: 4024 - protein, 8 aa, Homo sapiens
GYTFTSYG

SEQ ID NO: 4025 - protein, 8 aa, Homo sapiens
GYTFTNYG

SEQ ID NO: 4026 - protein, 8 aa, Homo sapiens
DYTFTYYG

SEQ ID NO: 4027 - protein, 8 aa, Homo sapiens
GYTFTSYG

SEQ ID NO: 4028 - protein, 8 aa, Homo sapiens
GFTFSTYG

SEQ ID NO: 4029-5000 - skipped (972 entries)

SEQ ID NO: 5001 - protein, 8 aa, Homo sapiens
IWYDGRNK

SEQ ID NO: 5002 - protein, 8 aa, Homo sapiens
IWYDGRNK

SEQ ID NO: 5003 - protein, 8 aa, Homo sapiens
NWYDGSNK

SEQ ID NO: 5004 - protein, 8 aa, Homo sapiens
IWYDGRNK

SEQ ID NO: 5005 - protein, 8 aa, Homo sapiens
IWYDGNNK

SEQ ID NO: 5006 - protein, 8 aa, Homo sapiens
IWYDGSYK

SEQ ID NO: 5007 - protein, 8 aa, Homo sapiens
IWYDGSNK

SEQ ID NO: 5008 - protein, 8 aa, Homo sapiens
IWYDGRNK

SEQ ID NO: 5009 - protein, 8 aa, Homo sapiens
IWYDGSNK

SEQ ID NO: 5010 - protein, 8 aa, Homo sapiens
IWYDGSNK

SEQ ID NO: 5011 - protein, 8 aa, Homo sapiens
IWYDVGNK

SEQ ID NO: 5012 - protein, 8 aa, Homo sapiens
IWYDGSNK

SEQ ID NO: 5013 - protein, 8 aa, Homo sapiens
IWYDGRNK

SEQ ID NO: 5014 - protein, 8 aa, Homo sapiens
IWYEGRNK

SEQ ID NO: 5015 - protein, 8 aa, Homo sapiens
IWYDGSNK

SEQ ID NO: 5016 - protein, 8 aa, Homo sapiens
IWYDGSNK

SEQ ID NO: 5017 - protein, 8 aa, Homo sapiens
ISGGGLST

SEQ ID NO: 5018 - protein, 8 aa, Homo sapiens
IWYDGSNK

SEQ ID NO: 5019 - protein, 8 aa, Homo sapiens
INPSVGST

SEQ ID NO: 5020 - protein, 8 aa, Homo sapiens
ISAYNGNT

SEQ ID NO: 5021 - protein, 8 aa, Homo sapiens
IWYDGNNK

SEQ ID NO: 5022 - protein, 8 aa, Homo sapiens
ISGSGGST

SEQ ID NO: 5023 - protein, 8 aa, Homo sapiens
ISAYNGNT

SEQ ID NO: 5024 - protein, 8 aa, Homo sapiens
ISAYNGNT

SEQ ID NO: 5025 - protein, 8 aa, Homo sapiens
ISVYNGNT

SEQ ID NO: 5026 - protein, 8 aa, Homo sapiens
ISAYNGNT

SEQ ID NO: 5027 - protein, 8 aa, Homo sapiens
ISAYNGNT

SEQ ID NO: 5028 - protein, 8 aa, Homo sapiens
TLYDGSNK

SEQ ID NO: 5029-6000 - skipped (972 entries)

SEQ ID NO: 6001 - protein, 12 aa, Homo sapiens
ARGEFFGEFFDY

SEQ ID NO: 6002 - protein, 12 aa, Homo sapiens
ARGGDWGPYFDY

SEQ ID NO: 6003 - protein, 12 aa, Homo sapiens
ARGGVWGPYFDY

SEQ ID NO: 6004 - protein, 11 aa, Homo sapiens
SRSGSFGAFDI

SEQ ID NO: 6005 - protein, 13 aa, Homo sapiens
ARGGILAAGIFDY

SEQ ID NO: 6006 - protein, 16 aa, Homo sapiens
ARAPHYAILTGYYEDY

SEQ ID NO: 6007 - protein, 11 aa, Homo sapiens
ARAHYFGAFDI

SEQ ID NO: 6008 - protein, 11 aa, Homo sapiens
ARAGELGPFDY

SEQ ID NO: 6009 - protein, 12 aa, Homo sapiens
ARGDILTGYYGY

SEQ ID NO: 6010 - protein, 11 aa, Homo sapiens
ARGGQLGPFDY

SEQ ID NO: 6011 - protein, 15 aa, Homo sapiens
ARDYYGSGSPRHFDY

SEQ ID NO: 6012 - protein, 11 aa, Homo sapiens
ARGGLMGAFDY

SEQ ID NO: 6013 - protein, 12 aa, Homo sapiens
ARGGLLGPYFDY

SEQ ID NO: 6014 - protein, 11 aa, Homo sapiens
ARAGDLGAFDI

SEQ ID NO: 6015 - protein, 11 aa, Homo sapiens
ARNGLIGAFDI

SEQ ID NO: 6016 - protein, 11 aa, Homo sapiens
ARGSLLGPFDY

SEQ ID NO: 6017 - protein, 11 aa, Homo sapiens
AKDLLWLGFDY

SEQ ID NO: 6018 - protein, 11 aa, Homo sapiens
ARGGHLGSFDY

SEQ ID NO: 6019 - protein, 16 aa, Homo sapiens
AREVRVRGVIIPFFDY

SEQ ID NO: 6020 - protein, 9 aa, Homo sapiens
AKVSGYFDY

SEQ ID NO: 6021 - protein, 15 aa, Homo sapiens
ARMLRGAPYYYGMDV

SEQ ID NO: 6022 - protein, 11 aa, Homo sapiens
AKLGIAWYFDV

SEQ ID NO: 6023 - protein, 11 aa, Homo sapiens
ARVTGRDAFDI

SEQ ID NO: 6024 - protein, 10 aa, Homo sapiens
ARVGPINLDY

SEQ ID NO: 6025 - protein, 10 aa, Homo sapiens
ARLGKGLFDY

SEQ ID NO: 6026 - protein, 13 aa, Homo sapiens
ARDYYDSSGYFDY

SEQ ID NO: 6027 - protein, 9 aa, Homo sapiens
GRWVRGVEY

SEQ ID NO: 6028 - protein, 11 aa, Homo sapiens
ARASLTGSFDY

SEQ ID NO: 6029-7000 - skipped (972 entries)

SEQ ID NO: 7001 - protein, 223 aa, Homo sapiens [sequence omitted]

SEQ ID NO: 7002 - protein, 8 aa, Artificial Sequence
  Description of Artificial Sequence: Synthetic peptide
DYKDDDDK

SEQ ID NO: 7003-7999 - skipped (997 entries)

SEQ ID NO: 8000 - protein, 107 aa, Homo sapiens
  Light chain
DIQMTQSPSSLSASVGDRVTITCRASQSISSYLNWYQQKPGKAPKLLIYASSSLQSGVPSRFSGSRSGTDFTLTISSLQPEDFATYYCQQSYSTPYTFGQGTKLEIK

SEQ ID NO: 8001 - protein, 107 aa, Homo sapiens
  Light chain
DIQMTQSPSSLSASVGDRVTITCRASQGISNYLAWYQQKPGKVPKLLIYAASTLQSGVPSRFSGSGSGTDFTLTISSLQPEDVATYYCQKYNSAPLTFGGGTKVEIK

SEQ ID NO: 8002 - protein, 107 aa, Homo sapiens
  Light chain
EIVMTQSPATLSVSPGERATLSCRASQSVSSNLAWYQQKPGQAPRLLIYGASTRATGIPARFSGSGSGTEFTLTISSLQSEDFAVYYCQQYNNWPYTFGQGTKLEIK

SEQ ID NO: 8003 - protein, 107 aa, Homo sapiens
  Light chain
DIQMTQSPSSLSASVGDRVTITCRASQGIRNDLGWYQQKPGKAPKRLIYAASSLQSGVPSRFSGSGSGTEFTLTISSLQPEDFATYYCLQHNTYPFTFGPGTKVDIK

SEQ ID NO: 8004 - protein, 107 aa, Homo sapiens
  Light chain
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPYTFGQGTKLEIK

SEQ ID NO: 8005 - protein, 107 aa, Homo sapiens; identical to SEQ ID NO: 8004
  Light chain

SEQ ID NO: 8006 - protein, 107 aa, Homo sapiens
  Light chain
DIQLTQSPSFLSASVGDRVTITCRASQGISSYLAWYQQKPGKAPKLLIYAASTLQSGVPSRFSGSGSGTEFTLTISSLQPEDFATYYCQQFNSYPYTFGQGTKLEIK

SEQ ID NO: 8007 - protein, 108 aa, Homo sapiens
  Light chain
EIVLTQSPGTLSLSPGERATLSCRASQSVSSSYLAWYQQKPGQAPRLLIYGASSRATGIPDRFSGSGSGTDFTLTISRLEPEDFAVYYCQQYGNSPYTFGQGTKLEIK

SEQ ID NO: 8008 - protein, 107 aa, Homo sapiens
  Light chain
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPWTFGQGTKVEIK

SEQ ID NO: 8009 - protein, 107 aa, Homo sapiens; identical to SEQ ID NO: 8008
  Light chain

SEQ ID NO: 8010 - protein, 107 aa, Homo sapiens; identical to SEQ ID NO: 8008
  Light chain

SEQ ID NO: 8011 - protein, 107 aa, Homo sapiens
  Light chain
DIQMTQSPSSLSASVGDRVTITCRASQVIRNDLGWYQQKPGKAPKRLIYAASSLQSGVPSRFTGSGSGTEFTLTISSLQPEDFATYYCLQHNSYPFTFGPGTKVDIK

SEQ ID NO: 8012 - protein, 108 aa, Homo sapiens
  Light chain
EIVLTQSPGILSLSPGERATLSCRTSQSVSSSYFAWYQQIPGQAPRLLIYGTSSRATGIPDRFSGSGSGTDFTLTISRLEPEDFAVYYCQQYGSSPRTFGQGTKVEIK

SEQ ID NO: 8013 - protein, 107 aa, Homo sapiens
  Light chain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSYTFGQGTKLEIK

SEQ ID NO: 8014 - protein, 107 aa, Homo sapiens
  Light chain
DIQMTQSPSSLSASVGDRVTITCRASQGISNYLAWYQQKPGKVPKLLIYAASTLQSGVPSRFSGSGSGTDFTLTISSLQPEDVATYYCQKYNSAPYTFGQGTKLEIK

SEQ ID NO: 8015 - protein, 107 aa, Homo sapiens
  Light chain
DIQMTQSPSSLSASVGDRVTITCRASQGIRNDLGWYQQKPGKAPKRLIYAASSLQSGVPSRFSGSGSGTEFTLTISSLQPEDFATYYCQQLNSYPRTFGQGTKVEIK

SEQ ID NO: 8016 - protein, 107 aa, Homo sapiens; identical to SEQ ID NO: 8008
  Light chain

SEQ ID NO: 8017 - protein, 107 aa, Homo sapiens
  Light chain
DIQMTQSPSSLSASVGDRVTITCRASQSISSYLNWYQQKPGKAPKLLIYAASSLQSGVPSRFSGSGSGTDFTLTISSLQPEDFATYYCQQSYSTPITFGQGTRLEIK

SEQ ID NO: 8018 - protein, 107 aa, Homo sapiens
  Light chain
DIQLTQSPSFLSAFVGDRVTITCRASQGISRYLAWYQQKPGKAPKLLIYTASTLQSGVPSRFSGSGSGTEFTLTISSLQPEDFATYYCQQLNSYPYTFGQGTKLEIK

SEQ ID NO: 8019 - protein, 107 aa, Homo sapiens; identical to SEQ ID NO: 8000
  Light chain

SEQ ID NO: 8020 - protein, 107 aa, Homo sapiens; identical to SEQ ID NO: 8000
  Light chain

SEQ ID NO: 8021 - protein, 107 aa, Homo sapiens; identical to SEQ ID NO: 8017
  Light chain

SEQ ID NO: 8022 - protein, 107 aa, Homo sapiens
  Light chain
DIQMTQSPSSLSASVGDRVTITCRASQGISSYLNWYQQKPGKAPKLLIYAASSLQSGVPSRFSGSGSGTDFTLTISSLQPEDFATYYCQQSYSYPYTFGQGTKLEIK

SEQ ID NO: 8023 - protein, 107 aa, Homo sapiens; identical to SEQ ID NO: 8000
  Light chain

SEQ ID NO: 8024 - protein, 107 aa, Homo sapiens; identical to SEQ ID NO: 8006
  Light chain

SEQ ID NO: 8025 - protein, 107 aa, Homo sapiens; identical to SEQ ID NO: 8000
  Light chain

SEQ ID NO: 8026 - protein, 107 aa, Homo sapiens; identical to SEQ ID NO: 8008
  Light chain

SEQ ID NO: 8027 - protein, 107 aa, Homo sapiens; identical to SEQ ID NO: 8015
  Light chain

SEQ ID NO: 8028 - protein, 108 aa, Homo sapiens
  Light chain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPYTFGQGTKLEIK

SEQ ID NO: 8029 - protein, 107 aa, Homo sapiens; identical to SEQ ID NO: 8000
  Light chain

SEQ ID NO: 8030 - protein, 107 aa, Homo sapiens
  Light chain
AIQMTQSPSSLSASVGDRVTITCRASQDIRNDLGWYQQKPGKAPKLLIYAASSLQSGVPSRFSGSGSGTDFTLTISSLQPEDFATYYCLQDYNYPWTFGQGTKVEIK

SEQ ID NO: 8031 - protein, 107 aa, Homo sapiens; identical to SEQ ID NO: 8013
  Light chain

SEQ ID NO: 8032 - protein, 107 aa, Homo sapiens; identical to SEQ ID NO: 8000
  Light chain

SEQ ID NO: 8033 - protein, 107 aa, Homo sapiens; identical to SEQ ID NO: 8000
  Light chain

SEQ ID NO: 8034 - protein, 107 aa, Homo sapiens; identical to SEQ ID NO: 8008
  Light chain

SEQ ID NO: 8035 - protein, 107 aa, Homo sapiens; identical to SEQ ID NO: 8006
  Light chain

SEQ ID NO: 8036 - protein, 107 aa, Homo sapiens; identical to SEQ ID NO: 8000
  Light chain

SEQ ID NO: 8037 - protein, 107 aa, Homo sapiens; identical to SEQ ID NO: 8000
  Light chain

SEQ ID NO: 8038 - protein, 107 aa, Homo sapiens; identical to SEQ ID NO: 8013
  Light chain

SEQ ID NO: 8039 - protein, 107 aa, Homo sapiens; identical to SEQ ID NO: 8008
  Light chain

SEQ ID NO: 8040 - protein, 108 aa, Homo sapiens
  Light chain
EIVMTQSPATLSLSPGERATLSCRASQSVSSSYLSWYQQKPGQAPRLLIHGASTRATGIPARFSGSGSGTDFTLTISSLQPEDFALYYCQQDYNLPYTFGQGTKLEIK

SEQ ID NO: 8041 - protein, 107 aa, Homo sapiens
  Light chain
DIQMTQSPSSLSASVGDRVTITCRASQGIRNDLGWYQQKPGKAPKRLIYAASSLQSGVPSRFSGSGSGTDFTLTISSLQPEDFATYYCQQSYSNPLTFGGGTKVEIK

SEQ ID NO: 8042 - protein, 107 aa, Homo sapiens; identical to SEQ ID NO: 8000
  Light chain

SEQ ID NO: 8043 - protein, 108 aa, Homo sapiens
  Light chain
EIVMTQSPATLSLSPGERATLSCRASQSVSSSYLSWYQQQPGQAPRLLIFGASTRATGIPARFSGSGSGTDFTLTISSLQPEDFAVYYCQQDYNLPLTFGGGTKLEIK

SEQ ID NO: 8044 - protein, 107 aa, Homo sapiens; identical to SEQ ID NO: 8006
  Light chain

SEQ ID NO: 8045 - protein, 107 aa, Homo sapiens; identical to SEQ ID NO: 8008
  Light chain

SEQ ID NO: 8046 - protein, 107 aa, Homo sapiens; identical to SEQ ID NO: 6
  Light chain

SEQ ID NO: 8047 - protein, 107 aa, Homo sapiens; identical to SEQ ID NO: 6
  Light chain

SEQ ID NO: 8048 - protein, 108 aa, Homo sapiens
  Light chain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWTFGQGTKVEIK

SEQ ID NO: 8049 - protein, 108 aa, Homo sapiens; identical to SEQ ID NO: 3
  Light chain

SEQ ID NO: 8050 - protein, 107 aa, Homo sapiens
  Light chain
DIQMTQSPSSLSASVGDRVTITCQASQDISNYLNWYQQKPGKAPKLLIYDASNLETGVPSRFSGSGSGTDFTFTISSLQPEDIATYYCQQYDNLPITFGQGTRLEIK

SEQ ID NO: 8051 - protein, 108 aa, Homo sapiens; identical to SEQ ID NO: 8048
  Light chain

SEQ ID NO: 8052 - protein, 108 aa, Homo sapiens; identical to SEQ ID NO: 8048
  Light chain

SEQ ID NO: 8053 - protein, 112 aa, Homo sapiens
  Light chain
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVEIK

SEQ ID NO: 8054 - protein, 107 aa, Homo sapiens; identical to SEQ ID NO: 6
  Light chain

SEQ ID NO: 8055 - protein, 108 aa, Homo sapiens; identical to SEQ ID NO: 8048
  Light chain

SEQ ID NO: 8056 - protein, 108 aa, Homo sapiens
  Light chain
EIVLTQSPGTLSLSPGERATLSCRASQSVSSSYLAWYQQKPGQAPRLLIYGASSRATGIPDRFSGSGSGTDFTLTISRLEPEDFVVYYCQQYGRSPWTFGQGTKVEIK

SEQ ID NO: 8057 - protein, 108 aa, Homo sapiens
  Light chain
EIVLTQSPGTLSLSPGERATLSCRASQSISSSYLAWYQQKPGQAPRLLIYGASSRATGIPDRFSGSGSGTDITLTISRLEPEDFAVYYCQQYGNSPWTFGQGTKVEIK

SEQ ID NO: 8058 - protein, 107 aa, Homo sapiens; identical to SEQ ID NO: 6
  Light chain

SEQ ID NO: 8059 - protein, 108 aa, Homo sapiens
  Light chain
EIVLTQSPGTLSLSPGERATLSCRASQSVSSSSLAWYQQKPGQAPRLLIYGASSRATGIPDRFSGSGSGTDFTLTISRLAPEDFAVYYCQQYGTSPWTFGQGTKVEIK

SEQ ID NO: 8060 - protein, 107 aa, Homo sapiens; identical to SEQ ID NO: 6
  Light chain

SEQ ID NO: 8061 - protein, 108 aa, Homo sapiens; identical to SEQ ID NO: 3
  Light chain

SEQ ID NO: 8062 - protein, 108 aa, Homo sapiens; identical to SEQ ID NO: 3
  Light chain

SEQ ID NO: 8063 - protein, 108 aa, Homo sapiens; identical to SEQ ID NO: 3
  Light chain

SEQ ID NO: 8064 - protein, 108 aa, Homo sapiens; identical to SEQ ID NO: 8048
  Light chain

SEQ ID NO: 8065 - protein, 112 aa, Homo sapiens; identical to SEQ ID NO: 8053
  Light chain

SEQ ID NO: 8066 - protein, 108 aa, Homo sapiens; identical to SEQ ID NO: 3
  Light chain

SEQ ID NO: 8067 - protein, 107 aa, Homo sapiens; identical to SEQ ID NO: 6
  Light chain

SEQ ID NO: 8068 - protein, 107 aa, Homo sapiens; identical to SEQ ID NO: 6
  Light chain

SEQ ID NO: 8069 - protein, 107 aa, Homo sapiens
  Light chain
DIQMTQSPSSLSASVGDRVTITCRASQSISSFLNWYQQKPGKAPKLLIYAASSLQSGVPSRFSGSGSGTDFTLTISSLQPEDFAAYYCQQGYSTPFTFGPGTKVDIK

SEQ ID NO: 8070 - protein, 108 aa, Homo sapiens; identical to SEQ ID NO: 8048
  Light chain

SEQ ID NO: 8071 - protein, 107 aa, Homo sapiens
  Light chain
DIQMTQSPSSLSASVGDRVTITCRASQSISSFLNWYQQKPGKAPKLLIYAASSLQSGVPSRFSGSGSGTDFTLTISSLQPEDFAAYYCQQSYSTPFAFGPGTKVDIK

SEQ ID NO: 8072 - protein, 107 aa, Homo sapiens; identical to SEQ ID NO: 6
  Light chain

SEQ ID NO: 8073 - protein, 108 aa, Homo sapiens; identical to SEQ ID NO: 3
  Light chain

SEQ ID NO: 8074 - protein, 107 aa, Homo sapiens; identical to SEQ ID NO: 6
  Light chain

SEQ ID NO: 8075 - protein, 108 aa, Homo sapiens; identical to SEQ ID NO: 8048
  Light chain

SEQ ID NO: 8076 - protein, 107 aa, Homo sapiens; identical to SEQ ID NO: 6
  Light chain

SEQ ID NO: 8077 - protein, 108 aa, Homo sapiens; identical to SEQ ID NO: 8048
  Light chain

SEQ ID NO: 8078 - protein, 108 aa, Homo sapiens; identical to SEQ ID NO: 8048
  Light chain

SEQ ID NO: 8079 - protein, 107 aa, Homo sapiens; identical to SEQ ID NO: 6
  Light chain

SEQ ID NO: 8080 - protein, 107 aa, Homo sapiens; identical to SEQ ID NO: 6
  Light chain

SEQ ID NO: 8081 - protein, 108 aa, Homo sapiens
  Light chain
EIVLTQSPGTLSLSPGERATLSCRASQSVSSSYLAWYQQKPGQAPRLLIYGASSRATGIPDRFSGSGSGTDFTLTISRLEPADFAVYHCQQFGSSPWTFGQGTKVEIK

SEQ ID NO: 8082 - protein, 107 aa, Homo sapiens
  Light chain
DIQMTQSPSFLSASVGDRVTITCRASQGISSYLAWYQQKPGKAPKLLIYAASTLQSGVPSRFSGSGSGTEFTLTISSLQPEDFATYYCQQLNSYPRTLGQGTKVEIK

SEQ ID NO: 8083 - protein, 112 aa, Homo sapiens; identical to SEQ ID NO: 8053
  Light chain

SEQ ID NO: 8084 - protein, 108 aa, Homo sapiens; identical to SEQ ID NO: 12
  Light chain

SEQ ID NO: 8085 - protein, 108 aa, Homo sapiens
  Light chain
EIVLTQSPGTLSLSPGERATLSCRASQSVSSSYLAWYQQKPGQAPRLLIYGASRRATGIPDRFSGSGSGTDFILTISRLEPEDFAVYYCQQYGTSPFTFGPGTRVDIK

SEQ ID NO: 8086 - protein, 108 aa, Homo sapiens
  Light chain
EIVLTQSPGTLSLSPGERATLSCRASQRAGSSYLAWYQQKSGQAPRLLIYGASSRATGIPDRFSGSGSGTDFTLTISRLEPEDFAVYYCQQYGNSPWTFGQGTKVEIK

SEQ ID NO: 8087 - protein, 107 aa, Homo sapiens
  Light chain
DIQMTQSPSSLSASVGDRVTITCRASQGIRNDLGWYQQKPGKAPKRLIYAASSLQSGVPSRFSGSGSGTDFTLTISSLQPEDFATYYCQQSYSTPYTFGQGTKLEIK

SEQ ID NO: 8088 - protein, 107 aa, Homo sapiens; identical to SEQ ID NO: 8008
  Light chain

SEQ ID NO: 8089 - protein, 112 aa, Homo sapiens; identical to SEQ ID NO: 8053
  Light chain

SEQ ID NO: 8090 - protein, 108 aa, Homo sapiens; identical to SEQ ID NO: 3
  Light chain

SEQ ID NO: 8091 - protein, 107 aa, Homo sapiens
  Light chain
DIQMTQSPSSLSASVGDRVTITCRASQGIRNDLGWYQQKPGKAPKRLIYAASSLQSGVPSRFSGSGSGTEFTLTISSLQPEDFATYYCLQHNSYPRTFGQGTKVEIK

SEQ ID NO: 8092 - protein, 107 aa, Homo sapiens; identical to SEQ ID NO: 8008
  Light chain

SEQ ID NO: 8093 - protein, 108 aa, Homo sapiens; identical to SEQ ID NO: 8086
  Light chain

SEQ ID NO: 8094 - protein, 107 aa, Homo sapiens
  Light chain
AIQMTQSPSSLSASVGDRVTITCRASQGIRNDLGWYQQKPGKAPKLLIYAASSLQSGVPSRFSGSGSGTDFTLTISSLQPEDFATYYCLQDYNYPRTFGQGTKVEIK

SEQ ID NO: 8095 - protein, 107 aa, Homo sapiens
  Light chain
AIQMTQSPSSLSASVGDRVTITCRASQGIRNDLGWYQQKPGKVPKLLIYAASSLQSGVPSRFSGSGSGTDFTLTISSLQPEDFATYYCLQDYNYPYTFGQGTKLEIK

SEQ ID NO: 8096 - protein, 107 aa, Homo sapiens; identical to SEQ ID NO: 8082
  Light chain

SEQ ID NO: 8097 - protein, 107 aa, Homo sapiens; identical to SEQ ID NO: 6
  Light chain

SEQ ID NO: 8098 - protein, 107 aa, Homo sapiens; identical to SEQ ID NO: 8094
  Light chain

SEQ ID NO: 8099 - protein, 112 aa, Homo sapiens; identical to SEQ ID NO: 8053
  Light chain

SEQ ID NO: 8100 - protein, 107 aa, Homo sapiens; identical to SEQ ID NO: 8008
  Light chain

SEQ ID NO: 8101 - protein, 107 aa, Homo sapiens
  Light chain
DIQMTQSPSSLSASVGDRVTITCRASQGIRNDLGWYQQKPGKAPKRLIYAASSLQSGVPSRFSGSGSGTEFTLTISSLQPEDFATYYCLQLNSYPRTFGQGTKVEIK

SEQ ID NO: 8102 - protein, 107 aa, Homo sapiens
  Light chain
AIQMTQSPSSLSASVGDRVTITCRASQGIRNDLGWYQQKPGKAPKLLIYAASSLQSGVPSRFSGSGSGTDFTLTISSLQPEDFATYYCLQNYNYPRTFGQGTKVEIN

SEQ ID NO: 8103 - protein, 108 aa, Homo sapiens
  Light chain
EIVMTQSPATLSLSPGERATLSCRASQSVSSSYLSWYQQRPGQAPRLLIYGASTRATGIPARFSGSGSGTDFTLTISSLQPEDFAVYYCQQDYNLPYTFGQGTKLEIK

SEQ ID NO: 8104 - protein, 107 aa, Homo sapiens; identical to SEQ ID NO: 8087
  Light chain

SEQ ID NO: 8105 - protein, 107 aa, Homo sapiens; identical to SEQ ID NO: 8082
  Light chain

SEQ ID NO: 8106 - protein, 107 aa, Homo sapiens; identical to SEQ ID NO: 8008
  Light chain

SEQ ID NO: 8107 - protein, 107 aa, Homo sapiens
  Light chain
DIQLTQSPSFLSASVGDRVTITCRASQGIRSYLAWYQQKPGKAPKLLIYAASTLQSGVPSRFSGSGSGTDFTLTISSLQPEDFATYYCQQYNSYPYTFGQGTKLEIK

SEQ ID NO: 8108 - protein, 107 aa, Homo sapiens
  Light chain
DIQMTQSPSSLSASVGDRVTITCRASQGIRNDLGWYQQKPGKAPKRLIYAASSLQSGVPSRFSGSGSGTEFTLTISSLQPEDFATYYCLQDYNYPWTFGQGTKVEIK

SEQ ID NO: 8109 - protein, 107 aa, Homo sapiens
  Light chain
DIQMTQSPSLLSASVGDRVTITCRASQGIRNDLGWYQQKPGKAPKRLIYAASSLQSGVPSRFSGSGSGTDFTLTISSLQPEDFATYYCQQYNSYPRTFGQGTKVEIK

SEQ ID NO: 8110 - protein, 107 aa, Homo sapiens; identical to SEQ ID NO: 6
  Light chain

SEQ ID NO: 8111 - protein, 108 aa, Homo sapiens
  Light chain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIK

SEQ ID NO: 8112 - protein, 107 aa, Homo sapiens
  Light chain
DIQMTQSPSSLSASVGDRVTITCRASQSISSYLNWYQQKPGKAPKLLIYAASSLQSGVPSRFSGSGSGTDFTLTISSLQPEDFATYYCLQHNSYPYTFGQGTKLEIK

SEQ ID NO: 8113 - protein, 107 aa, Homo sapiens; identical to SEQ ID NO: 6
  Light chain

SEQ ID NO: 8114 - protein, 107 aa, Homo sapiens; identical to SEQ ID NO: 6
  Light chain

SEQ ID NO: 8115 - protein, 107 aa, Homo sapiens; identical to SEQ ID NO: 8101
  Light chain

SEQ ID NO: 8116 - protein, 107 aa, Homo sapiens; identical to SEQ ID NO: 8108
  Light chain

SEQ ID NO: 8117 - protein, 107 aa, Homo sapiens; identical to SEQ ID NO: 8091
  Light chain

SEQ ID NO: 8118 - protein, 107 aa, Homo sapiens
  Light chain
DIQMTQSPSSLSASVGDRVTITCRASQSISSYLNWYQQKPGKAPKLLIYAASSLQSGVPSRFSGSGSGTDFTLTISSLQPEDFATYYCKQSYSTPYTFGQGTKLEIK

SEQ ID NO: 8119 - protein, 108 aa, Homo sapiens; identical to SEQ ID NO: 8086
  Light chain

SEQ ID NO: 8120 - protein, 107 aa, Homo sapiens
  Light chain
DIQMTQSPSSLSASVGDRVTITCRASQGIRNDLGWYQQKPGKAPKRLIYAASSLQSGVPSRFSGSGSGTEFTLTISSLQPEDFATYYCLQRNSYPWTFGQGTKVEIK

SEQ ID NO: 8121 - protein, 108 aa, Homo sapiens; identical to SEQ ID NO: 8081
  Light chain

SEQ ID NO: 8122 - protein, 107 aa, Homo sapiens; identical to SEQ ID NO: 8008
  Light chain

SEQ ID NO: 8123 - protein, 107 aa, Homo sapiens
  Light chain
DIQLTQSPSFLSASVGDRVTITCRASQGISSYLAWYQQKPGKAPKLLIYAASTLQSGVPSRFSGSGSGTEFTLTISSLQPEDFATYYCRQLNSYPWTFGQGTKVEIK

SEQ ID NO: 8124 - protein, 107 aa, Homo sapiens; identical to SEQ ID NO: 8109
  Light chain

SEQ ID NO: 8125 - protein, 107 aa, Homo sapiens
  Light chain
DIQMTQSPSSLSASVGDRVTITCRASQGIRNDLGWYQQKPGKAPKRLIYAASSLQSGVPSRFSGSGSGTEFTLTISSLQPEDFATYYCQQLNSYPWTFGQGTKVEIK

SEQ ID NO: 8126 - protein, 107 aa, Homo sapiens
  Light chain
DIQLTQSPSFLSASVGDRVTITCRASQGISSYLAWYQQKPGKAPKLLIYAASTLQSGVPSRFSGSGSGTEFTLTISSLQPEDFATYYCKQLNSYPRTFGQGTKVEIK

SEQ ID NO: 8127 - protein, 108 aa, Homo sapiens; identical to SEQ ID NO: 8081
  Light chain

SEQ ID NO: 8128 - protein, 107 aa, Homo sapiens; identical to SEQ ID NO: 8082
  Light chain

SEQ ID NO: 8129 - protein, 112 aa, Homo sapiens; identical to SEQ ID NO: 8053
  Light chain

SEQ ID NO: 8130 - protein, 107 aa, Homo sapiens; identical to SEQ ID NO: 8087
  Light chain

SEQ ID NO: 8131 - protein, 108 aa, Homo sapiens
  Light chain
EIVLTQSPGTLSLSPGERATLSCRASQSVSSSYLAWYQQKPGQAPRLLIYGASSRATGIPDRFSGSGSGTDCTLAISRLEPEDFAVYYCQQYGSSPWTFGQGTKVEIK

SEQ ID NO: 8132 - protein, 107 aa, Homo sapiens
  Light chain
DIQMTQSPSSLSASVGDRVTITCRASQGISNDLAWFQQKPGKAPKSLIYGASSLQSGVPSKFSGSGSGTDFTLTISSLQPEDFATYYCQQYNSYPYTFGQGTKLEIK

SEQ ID NO: 8133 - protein, 107 aa, Homo sapiens
  Light chain
DIQMTQSPSSLSASVGDRVTITCRASQDITNDLAWFQQKPGKAPKSLIYDASSLQSGVPSKFSGSGSGTDFTLTISSLQPEDFATYYCQQYKSYPYTFGLGTKLEIK

SEQ ID NO: 8134 - protein, 108 aa, Homo sapiens
  Light chain
EIVLTQSPGTLSLSPGERAILSCRASQSVSSNYLAWYQQKPGQAPRLLIYGASSRATGIPDRFSGSGSGTDFTLTISRLEPEDFAVYYCQQYGNSPFTFGPGTKVDIK

SEQ ID NO: 8135 - protein, 107 aa, Homo sapiens; identical to SEQ ID NO: 8133
  Light chain

SEQ ID NO: 8136 - protein, 108 aa, Homo sapiens
  Light chain
EIVLTQSPGTLSLSPGERATLSCRASQSVSSNYLAWYQQKPGQAPRLLIYGASSRATGIPDRFSGSGSGTDFTLTISRLEPEDFAVYYCQQYGSSPFTFGPGTKVDIK

SEQ ID NO: 8137 - protein, 108 aa, Homo sapiens; identical to SEQ ID NO: 8131
  Light chain

SEQ ID NO: 8138 - protein, 108 aa, Homo sapiens; identical to SEQ ID NO: 2
  Light chain

SEQ ID NO: 8139 - protein, 108 aa, Homo sapiens; identical to SEQ ID NO: 2
  Light chain

SEQ ID NO: 8140 - protein, 107 aa, Homo sapiens
  Light chain
DIQLTQSPSSLSASVGDRVTITCRVSQDISRLLNWYRQKPGEIPKLLIYRASSLQSGVPSRFSGSGSGTDFTLTISSLQPEDIATYYCQRTYSAPYTFGQGTKLEIK

SEQ ID NO: 8141 - protein, 107 aa, Homo sapiens
  Light chain
DIQLTQSPSFLSASVGDRVTITCRASQGINNYLAWYQQKPGKAPKLLIYAASTLQSGVPSRFSGTGSGTEFTLTISSLQPEDFATYSCQQLNNYPYTFGQGTKLEIT

SEQ ID NO: 8142 - protein, 108 aa, Homo sapiens; identical to SEQ ID NO: 8136
  Light chain

SEQ ID NO: 8143 - protein, 107 aa, Homo sapiens
  Light chain
DIQLTQSPSSLSASVGDRVTITCRVSQDISSFLNWYRQKPGDVPELLIYRSSNFQSGVPSRFSGSGSGTDFTLTISSLQPEDVATYYCQRTYNAPYTFGQGTKLEIK

SEQ ID NO: 8144 - protein, 108 aa, Homo sapiens
  Light chain
EIVLTQSPGTLSLSPGERATLSCRASQSVSSSYLAWYQQKPGQAPRLLIYGASSRATGIPDRFSGSGSGTDFTLTISRLEPEDFAVYYCQQFGSSPWTFGQGTKVEIK

SEQ ID NO: 8145 - protein, 108 aa, Homo sapiens; identical to SEQ ID NO: 8136
  Light chain

SEQ ID NO: 8146 - protein, 108 aa, Homo sapiens; identical to SEQ ID NO: 8136
  Light chain

SEQ ID NO: 8147 - protein, 108 aa, Homo sapiens; identical to SEQ ID NO: 8131
  Light chain

SEQ ID NO: 8148 - protein, 107 aa, Homo sapiens
  Light chain
EIVLTQSPDFQSVTPKEKVTITCRASQSIGSSLHWYQQKPDQSPKLLIKYASQSFSGVPSRFSGSGSGTDFTLTINSLEAEDAATYYCHQSSSLPFTFGPGTKVDIK

SEQ ID NO: 8149 - protein, 106 aa, Homo sapiens
  Light chain
EIVLTQSPDTLSLSPGERATLSCRASQSTNYLAWYQQKPGQAPRLLIYGASSRATGIPDRFSGSGSGTDFTLTISGLQPEDFAVYYCQQYGTSPWTFGQGTKVEIK

SEQ ID NO: 8150 - protein, 107 aa, Homo sapiens; identical to SEQ ID NO: 8148
  Light chain

SEQ ID NO: 8151 - protein, 108 aa, Homo sapiens
  Light chain
EIVMTQSPATLSLSPGERATLSCRASQSVSSSYLSWYQQKPGQAPRLLIHGASTRATGIPARFSGSGSGTDFTLTISSLQPEDFAVYYCQQDYNLPFTFGPGTKVDIK

SEQ ID NO: 8152 - protein, 108 aa, Homo sapiens
  Light chain
EIVLTQSPGTLSLSPGERATLSCRASQSISSSYLAWYQQKPGQAPRLLIYGASSRATGIPDRFSGSGSGTDFTLTISRLEPEDFAVYYCQQFGSSPFTFGPGTKVDIK

SEQ ID NO: 8153 - protein, 107 aa, Homo sapiens; identical to SEQ ID NO: 8133
  Light chain

SEQ ID NO: 8154 - protein, 107 aa, Homo sapiens; identical to SEQ ID NO: 8133
  Light chain

SEQ ID NO: 8155 - protein, 107 aa, Homo sapiens
  Light chain
DIQMTQSPSSLSASVGDRVTITCRASQDISNDLAWYQQKPGKVPKLLIYAASTLQSGVPSRFSGSGSGTDFTLTISSLQPKDVATYYCQKYDSAPFTFGQGTKLDIR

SEQ ID NO: 8156 - protein, 107 aa, Homo sapiens; identical to SEQ ID NO: 8141
  Light chain

SEQ ID NO: 8157 - protein, 108 aa, Homo sapiens; identical to SEQ ID NO: 8131
  Light chain

SEQ ID NO: 8158 - protein, 107 aa, Homo sapiens
  Light chain
DIQLTQSPSFLSAYVGDRVTITCRASQGISSFLAWYQQKPGKAPNLLIYAASTLQSGVPSRFSGTGSGTEFTLTISSLQPEDFATYYCQQLNNYPSTFGQGTKLEIK

SEQ ID NO: 8159 - protein, 107 aa, Homo sapiens; identical to SEQ ID NO: 8133
  Light chain

SEQ ID NO: 8160 - protein, 107 aa, Homo sapiens
  Light chain
DIQLTQSPSFLSASVGDRVTITCRASQGISSYLAWYQQKPGKAPKLLIYAASTLQSGVPSRFSGTGSGTEFTLTISSLQPEDFATYYCQQLNNYPCTFGQGTKLEIK

SEQ ID NO: 8161 - protein, 108 aa, Homo sapiens; identical to SEQ ID NO: 8131
  Light chain

SEQ ID NO: 8162 - protein, 107 aa, Homo sapiens; identical to SEQ ID NO: 8141
  Light chain

SEQ ID NO: 8163 - protein, 108 aa, Homo sapiens
  Light chain
EIVLTQSPGTLSLSPGERATLSCRASQSISSSYLAWYQQKPGQAPRLLIYGASSRATGIPDRFSGSGSGTDFTLTISRLEPEDFAVYYCQQFGRSPFTFGPGTKVDIK

SEQ ID NO: 8164 - protein, 108 aa, Homo sapiens; identical to SEQ ID NO: 8131
  Light chain

SEQ ID NO: 8165 - protein, 108 aa, Homo sapiens
  Light chain
EIVLTQSPGTLSLSPGERATLSCRASQSVSSSYLAWYQQKPGQAPRLLIYGASSRATGIPDRFSGSGSGTDFTLTISRLEPEDFAVYYCQQYGTSPFTFGHGTKVDIK

SEQ ID NO: 8166 - protein, 108 aa, Homo sapiens; identical to SEQ ID NO: 8136
  Light chain

SEQ ID NO: 8167 - protein, 108 aa, Homo sapiens; identical to SEQ ID NO: 2
  Light chain

SEQ ID NO: 8168 - protein, 107 aa, Homo sapiens; identical to SEQ ID NO: 8133
  Light chain

SEQ ID NO: 8169 - protein, 108 aa, Homo sapiens
  Light chain
EIVLTQSPGTLSLSPGERATLSCRASQSVSSSYLAWYQQKPGQAPRLLIYGASSRATGIPDRFSGSGSGTDFTLTISRLEPEDFAVYYCQQYSRSPWTFGQGTKVEIK

SEQ ID NO: 8170 - protein, 107 aa, Homo sapiens
  Light chain
DIQMTQSPSSLSASVGDRVTITCRASQGIGNDLAWFQQKPGKAPKSLIYGASSLQSGVPSKFSGSGSGTDFTLTISSLQPEDLATYYCQQYKTYPYTFGRGTKLEIK

SEQ ID NO: 8171 - protein, 108 aa, Homo sapiens; identical to SEQ ID NO: 8131
  Light chain

SEQ ID NO: 8172 - protein, 108 aa, Homo sapiens; identical to SEQ ID NO: 8152
  Light chain

SEQ ID NO: 8173 - protein, 108 aa, Homo sapiens; identical to SEQ ID NO: 8136
  Light chain

SEQ ID NO: 8174 - protein, 108 aa, Homo sapiens; identical to SEQ ID NO: 8131
  Light chain

SEQ ID NO: 8175 - protein, 108 aa, Homo sapiens
  Light chain
EIVLTQSPGTLSLSPGERATLSCRASQSVSSSYLAWYQQKPGQAPRLLIYGASSRATGIPDRFSGSGSGTDFTLTINRLEPEDFAVYYCQQYGRSPWTFGQGTKVEIK

SEQ ID NO: 8176 - protein, 107 aa, Homo sapiens; identical to SEQ ID NO: 8132
  Light chain

SEQ ID NO: 8177 - protein, 108 aa, Homo sapiens; identical to SEQ ID NO: 8136
  Light chain

SEQ ID NO: 8178 - protein, 108 aa, Homo sapiens
  Light chain
EIVLTQSPGTLSLSPGERATLSCRASPSISSSYLAWYQQKPGQAPRLLIYGASSRATGIPDRFSGSGSGTDFTLTISRLEPEDFAVYYCHQYGSSPFTFGPGTKVDIK

SEQ ID NO: 8179 - protein, 108 aa, Homo sapiens; identical to SEQ ID NO: 8131
  Light chain

SEQ ID NO: 8180 - protein, 107 aa, Homo sapiens; identical to SEQ ID NO: 8133
  Light chain

SEQ ID NO: 8181 - protein, 107 aa, Homo sapiens; identical to SEQ ID NO: 8132
  Light chain

SEQ ID NO: 8182 - protein, 108 aa, Homo sapiens; identical to SEQ ID NO: 3
  Light chain

SEQ ID NO: 8183 - protein, 107 aa, Homo sapiens
  Light chain
EIVLTQSPDFQSVTPKEKVTITCRASQNIGSSLHWYQQKPDQSPKLLIKYASQSFSGVPSRFSGSGSGTDFTLTINSLEAEDAATYYCHQSSSLPFTFGPGTKVDIK

SEQ ID NO: 8184 - protein, 107 aa, Homo sapiens
  Light chain
DIQMTQSPSSLSASVGDRVTITCRASQDISNDLAWYQQKPGKVPKLLIYAASTLQSGVPSRFSGSGSGTDFTLTISSLQPEDVATYYCQKYDSAPFTFGQGTKLDIR

SEQ ID NO: 8185 - protein, 107 aa, Homo sapiens; identical to SEQ ID NO: 8140
  Light chain

SEQ ID NO: 8186 - protein, 107 aa, Homo sapiens; identical to SEQ ID NO: 8140
  Light chain

SEQ ID NO: 8187 - protein, 108 aa, Homo sapiens; identical to SEQ ID NO: 8048
  Light chain

SEQ ID NO: 8188 - protein, 108 aa, Homo sapiens; identical to SEQ ID NO: 3
  Light chain

SEQ ID NO: 8189 - protein, 108 aa, Homo sapiens
  Light chain
EIVLTQSPGTLSLSPGERATLSCRASQSVSSNFLAWYQQKPGQAPRLLIYGASSRATGIPDRFSGSGSGTDFTLTISRLEPEDFAVYYCQQYGTSPWTFGQGTKVEIK

SEQ ID NO: 8190 - protein, 107 aa, Homo sapiens
  Light chain
DIQMTQSPSSLAASVGDRVTITCRASQGISNDLAWFQQKPGKAPKSLIYAASSLQSGVPSKFSGSGSGTDFTLSISSLQPEDFATYYCQQYKNYPYTFGQGTKLEIK

SEQ ID NO: 8191 - protein, 107 aa, Homo sapiens; identical to SEQ ID NO: 8143
  Light chain

SEQ ID NO: 8192 - protein, 107 aa, Homo sapiens; identical to SEQ ID NO: 8133
  Light chain

SEQ ID NO: 8193 - protein, 108 aa, Homo sapiens; identical to SEQ ID NO: 3
  Light chain

SEQ ID NO: 8194 - protein, 107 aa, Homo sapiens; identical to SEQ ID NO: 8140
  Light chain

SEQ ID NO: 8195 - protein, 107 aa, Homo sapiens
  Light chain
DIQLTQSPSFLSASVGDRVTITCRASQGISSFLAWYQQKPGKAPNLLIYAASTLHSGVPSRFGGTGSGTEFTLTISSLQPEDFATYYCQQLNNYPYTFGQGTKLEIK

SEQ ID NO: 8196 - protein, 108 aa, Homo sapiens; identical to SEQ ID NO: 8048
  Light chain

SEQ ID NO: 8197 - protein, 108 aa, Homo sapiens; identical to SEQ ID NO: 8048
  Light chain

SEQ ID NO: 8198 - protein, 107 aa, Homo sapiens; identical to SEQ ID NO: 8133
  Light chain

SEQ ID NO: 8199 - protein, 107 aa, Homo sapiens; identical to SEQ ID NO: 8132
  Light chain

SEQ ID NO: 8200 - protein, 108 aa, Homo sapiens; identical to SEQ ID NO: 8048
  Light chain

SEQ ID NO: 8201 - protein, 108 aa, Homo sapiens; identical to SEQ ID NO: 3
  Light chain

SEQ ID NO: 8202 - protein, 107 aa, Homo sapiens
  Light chain
DIQMTQSPSSLSASVGDRVTITCRASQGINNDLAWFQQKPGKAPKSLIYETSSLQSGVPSKFSGSGSGTDFTLTISSLQPEDFATYYCQQYKTYPYTFGQGTKLEIK

SEQ ID NO: 8203 - protein, 108 aa, Homo sapiens; identical to SEQ ID NO: 2
  Light chain

SEQ ID NO: 8204 - protein, 107 aa, Homo sapiens; identical to SEQ ID NO: 8140
  Light chain

SEQ ID NO: 8205 - protein, 108 aa, Homo sapiens; identical to SEQ ID NO: 8048
  Light chain

SEQ ID NO: 8206 - protein, 108 aa, Homo sapiens; identical to SEQ ID NO: 2
  Light chain

SEQ ID NO: 8207 - protein, 108 aa, Homo sapiens
  Light chain
EIVLTQSPGTLSLSPGERATLSCRASQSVSSNYLAWYQQKPGQAPRLLIYGASSRATGIPDRFSGSGSGTDFTLTISRLEPEDFAVYYCLRYGTSPFTFGPGTKVDIK

SEQ ID NO: 8208 - protein, 108 aa, Homo sapiens; identical to SEQ ID NO: 8151
  Light chain

SEQ ID NO: 8209 - protein, 107 aa, Homo sapiens
  Light chain
DIQMTQSPSSLSASVGDRVTITCRASQDITNDLAWFQQKPGKAPKSLIYDASSLQSGVPSKFSGSGSGTDFTLTISSLQPEDFATYYCQQYRSYPYTFGLGTKLEIK

SEQ ID NO: 8210 - protein, 108 aa, Homo sapiens; identical to SEQ ID NO: 8169
  Light chain

SEQ ID NO: 8211 - protein, 108 aa, Homo sapiens; identical to SEQ ID NO: 3
  Light chain

SEQ ID NO: 8212 - protein, 108 aa, Homo sapiens; identical to SEQ ID NO: 8189
  Light chain

SEQ ID NO: 8213 - protein, 107 aa, Homo sapiens
  Light chain
DIQMTQSPSSLSASVGDRVTITCRASQGISNDLAWFQQKPGKAPKSLIYDASSLQSGVPSKFSGSGSGTDFTLTISSLQPEDFATYYCQQYKSYPYTFGQGTKLEIK

SEQ ID NO: 8214 - protein, 107 aa, Homo sapiens; identical to SEQ ID NO: 8213
  Light chain

SEQ ID NO: 8215 - protein, 107 aa, Homo sapiens
  Light chain
DIQLTQSPSSLSASVGDRVTITCRVSQDISRLLNWYRQKPGEIPKLLIYRASSLQSGVPSRFSGSGSGTDFTLTITSLQPEDLATYYCQRTYSAPYTFGQGTKLEIK

SEQ ID NO: 8216 - protein, 108 aa, Homo sapiens
  Light chain
EIVLTQSPGTLSLSPGERATLSCRASQSVSGSYLAWYQQKPGQAPRLLIYGASSRATGIPDRFSGSGSGTDFTLTISRLEPEDFAVYYCQQYGSSPFTFGPGTKVDIK

SEQ ID NO: 8217 - protein, 107 aa, Homo sapiens
  Light chain
DIQLTQSPSFLSASVGDRVTITCRASQGISSYLAWYQQKPGKAPKLLIYAASTLQSGVPSRFSGTGSGTEFTLTISSLQPEDFATYYCQQLNNYPYTFGQGTKLEIK

SEQ ID NO: 8218 - protein, 108 aa, Homo sapiens
  Light chain
EIVLTQSPGTLSLSPGERATLSCRASQSVSSSYLAWYQQRPGQAPRLLIYGASSRATGIPDRFSGSGSGTDFTLTISRLEPEDFAVYYCQQYGRSPWTFGQGTKVEIK

SEQ ID NO: 8219 - protein, 108 aa, Homo sapiens; identical to SEQ ID NO: 8048
  Light chain

SEQ ID NO: 8220 - protein, 108 aa, Homo sapiens
  Light chain
EIVLTQSPGTLSLSPGERATLSCRASQSVSSSYLAWYQQKPGQAPRLLIYGASSRATDIPDRFSGSGSGTDFTLTISRLEPEDFAVYYCQQFGSSPFTFGPGTKVDIK

SEQ ID NO: 8221 - protein, 107 aa, Homo sapiens; identical to SEQ ID NO: 8132
  Light chain

SEQ ID NO: 8222 - protein, 107 aa, Homo sapiens; identical to SEQ ID NO: 8132
  Light chain

SEQ ID NO: 8223 - protein, 107 aa, Homo sapiens; identical to SEQ ID NO: 8190
  Light chain

SEQ ID NO: 8224 - protein, 107 aa, Homo sapiens; identical to SEQ ID NO: 8132
  Light chain

SEQ ID NO: 8225 - protein, 108 aa, Homo sapiens
  Light chain
EIVMTQSPATLSLSPGERATLSCRASQSVSSSYLSWYQQKPGQAPRLLIYGASTRATGIPARFSGSGSGTDFTLTISSLQPEDFAVYYCLQDYNLPFTFGPGTKVDIK

SEQ ID NO: 8226 - protein, 107 aa, Homo sapiens
  Light chain
DIQMTQSPSSLSASVGDRVTITCRASQGISNDLAWFQQKPGKAPKSLIYDASSLQSGVPSKFSGSGSGTDFTLTISSLQPEDFATYYCQQYKSYPFTFGQGTKLEIK

SEQ ID NO: 8227 - protein, 107 aa, Homo sapiens; identical to SEQ ID NO: 8132
  Light chain

SEQ ID NO: 8228 - protein, 107 aa, Homo sapiens; identical to SEQ ID NO: 8213
  Light chain

SEQ ID NO: 8229 - protein, 107 aa, Homo sapiens; identical to SEQ ID NO: 8213
  Light chain

SEQ ID NO: 8230 - protein, 107 aa, Homo sapiens
  Light chain
DIQMTQSPSSLSASLGDRVTITCRASQDISNDLAWFQQKPGKAPKSLIYETSSLQSGVPSKFSGSGSGTDFTLTISSLQPEDFASYYCQQYRSYPYTFGQGTKLEIK

SEQ ID NO: 8231 - protein, 107 aa, Homo sapiens; identical to SEQ ID NO: 8217
  Light chain

SEQ ID NO: 8232 - protein, 107 aa, Homo sapiens; identical to SEQ ID NO: 8213
  Light chain

SEQ ID NO: 8233 - protein, 108 aa, Homo sapiens; identical to SEQ ID NO: 8151
  Light chain

SEQ ID NO: 8234 - protein, 107 aa, Homo sapiens; identical to SEQ ID NO: 8213
  Light chain

SEQ ID NO: 8235 - protein, 108 aa, Homo sapiens; identical to SEQ ID NO: 8218
  Light chain

SEQ ID NO: 8236 - protein, 108 aa, Homo sapiens; identical to SEQ ID NO: 8151
  Light chain

SEQ ID NO: 8237 - protein, 107 aa, Homo sapiens; identical to SEQ ID NO: 8213
  Light chain

SEQ ID NO: 8238 - protein, 108 aa, Homo sapiens; identical to SEQ ID NO: 8048
  Light chain

SEQ ID NO: 8239 - protein, 108 aa, Homo sapiens
  Light chain
EIVLTQSPGTLSLSPGERATLSCRASQSVSSSYLAWYQQKPGQAPRLLIYGASSRATGIPDRFSGSGSGTDFTLTISRLEPEDFAVYYCQQYGISPFTFGPGTKVDIK

SEQ ID NO: 8240 - protein, 108 aa, Homo sapiens; identical to SEQ ID NO: 8144
  Light chain

SEQ ID NO: 8241 - protein, 108 aa, Homo sapiens
  Light chain
EIVLTQSPGTLSLSPGERATLSCRASQSGSSSYLAWYQQKPGQAPRLLIYGASSRATGIPDRFSGSGSGTDFTLTISRLEPEDFAVYYCQQYGSSPFTFGPGTKVDIK

SEQ ID NO: 8242 - protein, 108 aa, Homo sapiens; identical to SEQ ID NO: 8048
  Light chain

SEQ ID NO: 8243 - protein, 108 aa, Homo sapiens; identical to SEQ ID NO: 8241
  Light chain

SEQ ID NO: 8244 - protein, 108 aa, Homo sapiens
  Light chain
EIVLTQSPGTLSLSPGERATLSCRASQSVSSSYLAWYQQKPGQAPRLLIYGASSRATGIPDRFSGSGSGTDFTLTISRLEPEDFAVYYCQQYGNSPFTFGPGTKVDIK

SEQ ID NO: 8245 - protein, 112 aa, Homo sapiens
  Light chain
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQSLQTPPTFGQGTKVEIK

SEQ ID NO: 8246 - protein, 108 aa, Homo sapiens
  Light chain
EIVLTQSPGTLSLSPGERATLSCRASQSDSSSYLAWYQQKPGQAPRPLIYGASSRATGIPDRFSGSGSGTDFTLTISRLEPEDFAVYYCQQYGRSPWTFGQGTKVEIK

SEQ ID NO: 8247 - protein, 107 aa, Homo sapiens
  Light chain
DIQMTQSPSSLSASVGDRVTITCRASQSISSYLSWYQRKPGKAPKLLIYAASSLQSGVPSRFSGSGSGTDFTLTISSLQPEDFATYYCQQSYSIPLTFGGGTKVEIK

SEQ ID NO: 8248 - protein, 112 aa, Homo sapiens; identical to SEQ ID NO: 8245
  Light chain

SEQ ID NO: 8249 - protein, 107 aa, Homo sapiens
  Light chain
EIVLTQSPDFQSVTPKEKVTITCRASQSIGSSLHWYQQKPDQSPKLLIKYASQSISGVPSRFSGSGSGTDFTLTINSLEAEDAAAYYCHQSSSLPFTFGPGTKVDIK

SEQ ID NO: 8250 - protein, 108 aa, Homo sapiens; identical to SEQ ID NO: 8239
  Light chain

SEQ ID NO: 8251 - protein, 107 aa, Homo sapiens
  Light chain
DIQMTQSPSSLSASVGDRVTITCRASQGISNYLAWFQQKPGKAPKSLIYAASSLQSGVPSKFSGSGSGTDFTLTISSLQPEDFATYYCQLYNSYPFTFGPGTKVDIK

SEQ ID NO: 8252 - protein, 108 aa, Homo sapiens; identical to SEQ ID NO: 8239
  Light chain

SEQ ID NO: 8253 - protein, 108 aa, Homo sapiens
  Light chain
EIVLTQSPGTLSLSPGERATLSCRASQSVSSTYLAWYQQKPGQAPRLLIYGASSRATGIPDRFSGSGSGTDFTLTISRLEPEDFAVYYCQQFGSSPFTFGPGTKLDIK

SEQ ID NO: 8254 - protein, 108 aa, Homo sapiens; identical to SEQ ID NO: 8048
  Light chain

SEQ ID NO: 8255 - protein, 108 aa, Homo sapiens; identical to SEQ ID NO: 8241
  Light chain

SEQ ID NO: 8256 - protein, 108 aa, Homo sapiens
  Light chain
EIVMTQSPATLSLSPGERATLSCRASQSVSSSYLSWYQQKPGQAPRLLIYGASTRATGIPARFSGSGSGTDFTLTISSLQPEDFAVYYCQQDYNLPFTFGPGTKVDIK

SEQ ID NO: 8257 - protein, 108 aa, Homo sapiens; identical to SEQ ID NO: 8241
  Light chain

SEQ ID NO: 8258 - protein, 108 aa, Homo sapiens; identical to SEQ ID NO: 8048
  Light chain

SEQ ID NO: 8259 - protein, 108 aa, Homo sapiens; identical to SEQ ID NO: 8256
  Light chain

SEQ ID NO: 8260 - protein, 108 aa, Homo sapiens; identical to SEQ ID NO: 8048
  Light chain

SEQ ID NO: 8261 - protein, 108 aa, Homo sapiens
  Light chain
EIVLTQSPGTLSLSPGERATLSCRASQSVSSSYLAWYQQKPGQAPRLLIYGASSRATGIPDRFSGSGSGTDFTLTISRLEPEDFAVYYCQHYGSSPWTFGQGTKVEIK

SEQ ID NO: 8262 - protein, 108 aa, Homo sapiens; identical to SEQ ID NO: 8241
  Light chain

SEQ ID NO: 8263 - protein, 108 aa, Homo sapiens; identical to SEQ ID NO: 8048
  Light chain

SEQ ID NO: 8264 - protein, 108 aa, Homo sapiens; identical to SEQ ID NO: 8144
  Light chain

SEQ ID NO: 8265 - protein, 108 aa, Homo sapiens; identical to SEQ ID NO: 8241
  Light chain

SEQ ID NO: 8266 - protein, 108 aa, Homo sapiens
  Light chain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPWAFGQGTKVEIK

SEQ ID NO: 8267 - protein, 108 aa, Homo sapiens; identical to SEQ ID NO: 8239
  Light chain

SEQ ID NO: 8268 - protein, 108 aa, Homo sapiens; identical to SEQ ID NO: 8239
  Light chain

SEQ ID NO: 8269 - protein, 108 aa, Homo sapiens; identical to SEQ ID NO: 8241
  Light chain

SEQ ID NO: 8270 - protein, 108 aa, Homo sapiens
  Light chain
EIVLTQSPGTLSLSPGERATLSCRASQSVSSTYLAWYQQKPGQAPRLLIYGASSRATGIPDRFSGSGSGTDFTLTISRLEPEDFAVYYCQQLGSSPFTFGPGTKLDIK

SEQ ID NO: 8271 - protein, 108 aa, Homo sapiens; identical to SEQ ID NO: 8241
  Light chain

SEQ ID NO: 8272 - protein, 112 aa, Homo sapiens; identical to SEQ ID NO: 8053
  Light chain

SEQ ID NO: 8273 - protein, 108 aa, Homo sapiens; identical to SEQ ID NO: 8048
  Light chain

SEQ ID NO: 8274 - protein, 108 aa, Homo sapiens; identical to SEQ ID NO: 8048
  Light chain

SEQ ID NO: 8275 - protein, 108 aa, Homo sapiens; identical to SEQ ID NO: 8048
  Light chain

SEQ ID NO: 8276 - protein, 108 aa, Homo sapiens; identical to SEQ ID NO: 3
  Light chain

SEQ ID NO: 8277 - protein, 108 aa, Homo sapiens; identical to SEQ ID NO: 3
  Light chain

SEQ ID NO: 8278 - protein, 108 aa, Homo sapiens
  Light chain
EIVLTQSPGTLSLSPGERATLSCRASQTISSSYLAWYQQKPGQAPRLLIYGASSRATGIPDRFSGSGSGTDFTLTISRLEPEDFAVYYCQQYGISPFTFGPGTKVDIK

SEQ ID NO: 8279 - protein, 108 aa, Homo sapiens; identical to SEQ ID NO: 8048
  Light chain

SEQ ID NO: 8280 - protein, 108 aa, Homo sapiens; identical to SEQ ID NO: 8048
  Light chain

SEQ ID NO: 8281 - protein, 106 aa, Homo sapiens
  Light chain
EIVLTQSPGTLSLSPGERATLSCRASQSVSYLAWYQQKPGQAPRLLIYGASSRATGIPDRFSGSGSGTDFTLTISRLEPEDFAVYYCQHYGSSPWTFGQGTKVEIK

SEQ ID NO: 8282 - protein, 108 aa, Homo sapiens; identical to SEQ ID NO: 3
  Light chain

SEQ ID NO: 8283 - protein, 106 aa, Homo sapiens; identical to SEQ ID NO: 8281
  Light chain

SEQ ID NO: 8284 - protein, 108 aa, Homo sapiens; identical to SEQ ID NO: 3
  Light chain

SEQ ID NO: 8285 - protein, 108 aa, Homo sapiens; identical to SEQ ID NO: 3
  Light chain

SEQ ID NO: 8286 - protein, 108 aa, Homo sapiens; identical to SEQ ID NO: 3
  Light chain

SEQ ID NO: 8287 - protein, 108 aa, Homo sapiens; identical to SEQ ID NO: 8278
  Light chain

SEQ ID NO: 8288 - protein, 108 aa, Homo sapiens
  Light chain
EIVLTQSPGTLSLSPGERATLSCRASQSVSSSYLAWYQQKPGQAPRLLIYGASSRATGIPDRFSGSGSGTDFTLTISRLEPEDFAVYYCQQYGTSPFTFGPGTKVDIK

SEQ ID NO: 8289 - protein, 108 aa, Homo sapiens; identical to SEQ ID NO: 3
  Light chain

SEQ ID NO: 8290 - protein, 108 aa, Homo sapiens; identical to SEQ ID NO: 3
  Light chain

SEQ ID NO: 8291 - protein, 108 aa, Homo sapiens; identical to SEQ ID NO: 3
  Light chain

SEQ ID NO: 8292 - protein, 108 aa, Homo sapiens; identical to SEQ ID NO: 8288
  Light chain

SEQ ID NO: 8293 - protein, 108 aa, Homo sapiens; identical to SEQ ID NO: 3
  Light chain

SEQ ID NO: 8294 - protein, 108 aa, Homo sapiens; identical to SEQ ID NO: 3
  Light chain

SEQ ID NO: 8295 - protein, 108 aa, Homo sapiens; identical to SEQ ID NO: 8048
  Light chain

SEQ ID NO: 8296 - protein, 108 aa, Homo sapiens; identical to SEQ ID NO: 3
  Light chain

SEQ ID NO: 8297 - protein, 108 aa, Homo sapiens; identical to SEQ ID NO: 2
  Light chain

SEQ ID NO: 8298 - protein, 108 aa, Homo sapiens; identical to SEQ ID NO: 3
  Light chain

SEQ ID NO: 8299 - protein, 108 aa, Homo sapiens; identical to SEQ ID NO: 3
  Light chain

SEQ ID NO: 8300 - protein, 108 aa, Homo sapiens; identical to SEQ ID NO: 3
  Light chain

SEQ ID NO: 8301 - protein, 108 aa, Homo sapiens; identical to SEQ ID NO: 8048
  Light chain

SEQ ID NO: 8302 - protein, 108 aa, Homo sapiens
  Light chain
EIVLTQSPGTLSLSPGERATLSCRASQSVSSTYLAWYQQKPGQAPRLLIYGASSRATGIPDRFSGSGSGTDFTLTISRLEPEDFAVYYCQQFGSSPFTFGPGTKVDIK

SEQ ID NO: 8303 - protein, 108 aa, Homo sapiens; identical to SEQ ID NO: 3
  Light chain

SEQ ID NO: 8304 - protein, 107 aa, Homo sapiens
  Light chain
DIQMTQSPSSLSASVGDRVTITCRASQSISSYLNWYQQKPGKAPKLLIYAASSLLSGVPSRFSGSGSGTDFTLTISSLQPEDFATYYCQQSYSTPLTFGGGTKVEIK

SEQ ID NO: 8305 - protein, 108 aa, Homo sapiens; identical to SEQ ID NO: 3
  Light chain

SEQ ID NO: 8306 - protein, 107 aa, Homo sapiens
  Light chain
DIQMTQSPSSLSASVGDRVTITCRASQGISNYLAWFQQKPGKAPKSLIYAASSLQSGVPSKFSGSGSGTDFTLTISSLQPEDFATYYCQQYNSYPYTFGQGTKLEIK

SEQ ID NO: 8307 - protein, 108 aa, Homo sapiens
  Light chain
EIVLTQSPGTLSLSPGERATLSCRASQSVSSSYLAWYQQKPGQAPRLLIYGTSSRATGIPDRFSGSGSGTDFTLTISRLEPEDFAVYYCQQYGTSPWTFGQGTKVEIK

SEQ ID NO: 8308 - protein, 108 aa, Homo sapiens
  Light chain
EIVMTQSPATLSLSPGERATLTCRASQSGSSSYLSWYQQKAGQAPRLLIYGASTRATGIPARFSGSGSGTDFTLTISSLQPEDFAVYYCHQDYNLPYTFGQGTKLEIK

SEQ ID NO: 8309 - protein, 108 aa, Homo sapiens; identical to SEQ ID NO: 8048
  Light chain

SEQ ID NO: 8310 - protein, 108 aa, Homo sapiens; identical to SEQ ID NO: 3
  Light chain

SEQ ID NO: 8311 - protein, 108 aa, Homo sapiens; identical to SEQ ID NO: 3
  Light chain

SEQ ID NO: 8312 - protein, 107 aa, Homo sapiens; identical to SEQ ID NO: 8304
  Light chain

SEQ ID NO: 8313 - protein, 108 aa, Homo sapiens; identical to SEQ ID NO: 8278
  Light chain

SEQ ID NO: 8314 - protein, 106 aa, Homo sapiens; identical to SEQ ID NO: 8281
  Light chain

SEQ ID NO: 8315 - protein, 113 aa, Homo sapiens
  Light chain
DIVMTQSPDSLAVSLGERATINCKSSQSVLYRSNNKNYLAWYQQKPGQPPKVLIYWASTRESGVPDRFSGSGSGTDFTLTISSLQAEDVAVYYCHQYYSTPYTFGQGTKLEIK

SEQ ID NO: 8316 - protein, 108 aa, Homo sapiens
  Light chain
EIVMTQSPATLSLSPGERATLSCRASQSVSSSYLSWYQQKPGQAPRLLIYGASTRATGIPARFSGSGSGTDFTLTISSLQPEDFAVYYCQQDYNLPYTFGQGTKLEIK

SEQ ID NO: 8317 - protein, 113 aa, Homo sapiens
  Light chain
DIVMTQSPDSLAVSLGERATINCKSSQSVLYSSNNKNYLAWYQQKPGQPPKVLIYWASTRESGVPDRFSGSGSGTDFTLTISSLQAEDVAVYYCQQYCSTPYTFGQGTKLEIK

SEQ ID NO: 8318 - protein, 106 aa, Homo sapiens
  Light chain
EIVLTQSPDFQSVTPKEKVTITCRASQSIGSSLHWYQQKPDQSPKLLIKYASQSISGVPSRFSGSGSGTDFTLTINSLEAEDAAAYYCHQSSSLPTFGQGTKLEIK

SEQ ID NO: 8319 - protein, 112 aa, Homo sapiens
  Light chain
DIVMTQSPLSLPVTPGEPASISCRSSQSLLHSNGLNYLDWYLQKPGQSPQLLIYLGSNRASGVPDRFSGSGSGTDFTLKISRVEAEDVGVYYCMQALQTPITFGQGTRLEIK

SEQ ID NO: 8320 - protein, 111 aa, Homo sapiens
  Light chain
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQSLQTITFGQGTRLEIK

SEQ ID NO: 8321 - protein, 108 aa, Homo sapiens; identical to SEQ ID NO: 8048
  Light chain

SEQ ID NO: 8322 - protein, 107 aa, Homo sapiens
  Light chain
DIQMTQSPSSLSASVGDRVTITCRASQGISNYLAWYQQKPGKVPKLLIYAASTLQSGVPSRFSGSGSGTDFTLTISSLQPEDVATYYCQKYNSAPWTFGQGTKVEIK

SEQ ID NO: 8323 - protein, 108 aa, Homo sapiens; identical to SEQ ID NO: 3
  Light chain

SEQ ID NO: 8324 - protein, 108 aa, Homo sapiens
  Light chain
EIVMTQSPATLSLSPGKRATLSCRASQSVSSSYLSWYQQKPGQAPRLLIYGASTRATGIPARFSGSGSGTNFTLTISSLQPEDFAVYYCQHVYHLPWTFGQGTKVEFK

SEQ ID NO: 8325 - protein, 108 aa, Homo sapiens; identical to SEQ ID NO: 3
  Light chain

SEQ ID NO: 8326 - protein, 108 aa, Homo sapiens; identical to SEQ ID NO: 3
  Light chain

SEQ ID NO: 8327 - protein, 108 aa, Homo sapiens; identical to SEQ ID NO: 8048
  Light chain

SEQ ID NO: 8328 - protein, 108 aa, Homo sapiens
  Light chain
EIVMTQSPATLSLSPGERATLSCRASQSVSSNYLSWYQQKPGQAPRLLIYGASTRATGIPARFSGSGSGTDFTLTISSLQPEDFAVYYCQQDYNLPLTFGGGTKVEIK

SEQ ID NO: 8329 - protein, 108 aa, Homo sapiens; identical to SEQ ID NO: 3
  Light chain

SEQ ID NO: 8330 - protein, 108 aa, Homo sapiens; identical to SEQ ID NO: 3
  Light chain

SEQ ID NO: 8331 - protein, 108 aa, Homo sapiens
  Light chain
EIVMTQSPATLSLPPGERATLSCRASQSFSSSYLSWYQQKPGQAPRLLIYGASTRATGIPARFSGSGSGTDFTLTISSLQPEDFAVYYCQQAYNLPYTFGQGTKLEIK

SEQ ID NO: 8332 - protein, 107 aa, Homo sapiens; identical to SEQ ID NO: 8304
  Light chain

SEQ ID NO: 8333 - protein, 108 aa, Homo sapiens; identical to SEQ ID NO: 3
  Light chain

SEQ ID NO: 8334 - protein, 108 aa, Homo sapiens; identical to SEQ ID NO: 8256
  Light chain

SEQ ID NO: 8335 - protein, 108 aa, Homo sapiens; identical to SEQ ID NO: 3
  Light chain

SEQ ID NO: 8336 - protein, 108 aa, Homo sapiens; identical to SEQ ID NO: 3
  Light chain

SEQ ID NO: 8337 - protein, 107 aa, Homo sapiens
  Light chain
DIQMTQSPSSLSASVGDRVTITCRANQGIRYDLGWYQQKPGKAPKRLISSASSLQSGVPSRFSGSGSGTEFTLTISSLQPEDFATYYCLQHNSYPFTFGPGTKVDIK

SEQ ID NO: 8338 - protein, 108 aa, Homo sapiens; identical to SEQ ID NO: 3
  Light chain

SEQ ID NO: 8339 - protein, 108 aa, Homo sapiens; identical to SEQ ID NO: 8278
  Light chain

SEQ ID NO: 8340 - protein, 108 aa, Homo sapiens; identical to SEQ ID NO: 8307
  Light chain

SEQ ID NO: 8341 - protein, 108 aa, Homo sapiens; identical to SEQ ID NO: 8278
  Light chain

SEQ ID NO: 8342 - protein, 108 aa, Homo sapiens; identical to SEQ ID NO: 3
  Light chain

SEQ ID NO: 8343 - protein, 108 aa, Homo sapiens
  Light chain
EIVMTQSPATLSLSPGERATLSCRASQTVSSIYLSWYQQKPGQAPRLLIYGSSTRATGIPARFSGSGSGTDFTLTISSLQPEDFAVYYCQQDYKLPYTFGQGTKLEIK

SEQ ID NO: 8344 - protein, 108 aa, Homo sapiens
  Light chain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSLWTFGQGTKVEIK

SEQ ID NO: 8345 - protein, 108 aa, Homo sapiens; identical to SEQ ID NO: 8288
  Light chain

SEQ ID NO: 8346 - protein, 108 aa, Homo sapiens; identical to SEQ ID NO: 2
  Light chain

SEQ ID NO: 8347 - protein, 108 aa, Homo sapiens; identical to SEQ ID NO: 8048
  Light chain

SEQ ID NO: 8348 - protein, 108 aa, Homo sapiens; identical to SEQ ID NO: 8256
  Light chain

SEQ ID NO: 8349 - protein, 108 aa, Homo sapiens
  Light chain
EIVLTQSPGTLSLSPGERATLSCRASQSVSSSYLAWYQQKPGQAPRLLIYGASSRATVIPDRFSGSGSGTDFTLTITRLEPEDFAVYYCQQYGVSPFTFGPGTKVDIK

SEQ ID NO: 8350 - protein, 108 aa, Homo sapiens
  Light chain
EIVLTQSPGTLSLSPGERATLSCRASQSVSSSCLAWYQQKPGQAPRLLIYGASSRATGIPDRFSGSGSGTDFTLTISRLEPEDFAVYYCQQYGISPFTFGPGTKVDIK

SEQ ID NO: 8351 - protein, 108 aa, Homo sapiens; identical to SEQ ID NO: 8350
  Light chain

SEQ ID NO: 8352 - protein, 108 aa, Homo sapiens; identical to SEQ ID NO: 3
  Light chain

SEQ ID NO: 8353 - protein, 108 aa, Homo sapiens
  Light chain
EIVLTQSPGTLSLSPGERATLSCRASQSVSSSYLAWYQQTPGQAPRLLIYGASSRATGIPDRFSGSGSGTDFTLTISRLEAEDFAVYYCQQYGTSPFTFGPGTIVDIK

SEQ ID NO: 8354 - protein, 108 aa, Homo sapiens; identical to SEQ ID NO: 3
  Light chain

SEQ ID NO: 8355 - protein, 108 aa, Homo sapiens; identical to SEQ ID NO: 3
  Light chain

SEQ ID NO: 8356 - protein, 108 aa, Homo sapiens; identical to SEQ ID NO: 3
  Light chain

SEQ ID NO: 8357 - protein, 106 aa, Homo sapiens; identical to SEQ ID NO: 8281
  Light chain

SEQ ID NO: 8358 - protein, 108 aa, Homo sapiens; identical to SEQ ID NO: 3
  Light chain

SEQ ID NO: 8359 - protein, 108 aa, Homo sapiens; identical to SEQ ID NO: 8353
  Light chain

SEQ ID NO: 8360 - protein, 108 aa, Homo sapiens; identical to SEQ ID NO: 3
  Light chain

SEQ ID NO: 8361 - protein, 112 aa, Homo sapiens
  Light chain
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQTLQTPPTFGQGTKVEIK

SEQ ID NO: 8362 - protein, 108 aa, Homo sapiens; identical to SEQ ID NO: 3
  Light chain

SEQ ID NO: 8363 - protein, 108 aa, Homo sapiens; identical to SEQ ID NO: 8350
  Light chain

SEQ ID NO: 8364 - protein, 108 aa, Homo sapiens; identical to SEQ ID NO: 3
  Light chain

SEQ ID NO: 8365 - protein, 108 aa, Homo sapiens; identical to SEQ ID NO: 8350
  Light chain

SEQ ID NO: 8366 - protein, 108 aa, Homo sapiens; identical to SEQ ID NO: 8353
  Light chain

SEQ ID NO: 8367 - protein, 108 aa, Homo sapiens; identical to SEQ ID NO: 8350
  Light chain

SEQ ID NO: 8368 - protein, 108 aa, Homo sapiens; identical to SEQ ID NO: 8350
  Light chain

SEQ ID NO: 8369 - protein, 108 aa, Homo sapiens; identical to SEQ ID NO: 8353
  Light chain

SEQ ID NO: 8370 - protein, 108 aa, Homo sapiens; identical to SEQ ID NO: 8350
  Light chain

SEQ ID NO: 8371 - protein, 108 aa, Homo sapiens; identical to SEQ ID NO: 3
  Light chain

SEQ ID NO: 8372 - protein, 108 aa, Homo sapiens; identical to SEQ ID NO: 8350
  Light chain

SEQ ID NO: 8373 - protein, 108 aa, Homo sapiens; identical to SEQ ID NO: 8350
  Light chain

SEQ ID NO: 8374 - protein, 108 aa, Homo sapiens; identical to SEQ ID NO: 3
  Light chain

SEQ ID NO: 8375 - protein, 108 aa, Homo sapiens; identical to SEQ ID NO: 2
  Light chain

SEQ ID NO: 8376 - protein, 108 aa, Homo sapiens; identical to SEQ ID NO: 3
  Light chain

SEQ ID NO: 8377 - protein, 108 aa, Homo sapiens; identical to SEQ ID NO: 8048
  Light chain

SEQ ID NO: 8378 - protein, 107 aa, Homo sapiens; identical to SEQ ID NO: 8249
  Light chain

SEQ ID NO: 8379 - protein, 108 aa, Homo sapiens; identical to SEQ ID NO: 3
  Light chain

SEQ ID NO: 8380 - protein, 107 aa, Homo sapiens; identical to SEQ ID NO: 17
  Light chain

SEQ ID NO: 8381 - protein, 108 aa, Homo sapiens; identical to SEQ ID NO: 3
  Light chain

SEQ ID NO: 8382 - protein, 108 aa, Homo sapiens; identical to SEQ ID NO: 3
  Light chain

SEQ ID NO: 8383 - protein, 108 aa, Homo sapiens; identical to SEQ ID NO: 8048
  Light chain

SEQ ID NO: 8384 - protein, 108 aa, Homo sapiens; identical to SEQ ID NO: 27
  Light chain

SEQ ID NO: 8385 - protein, 107 aa, Homo sapiens; identical to SEQ ID NO: 17
  Light chain

SEQ ID NO: 8386 - protein, 108 aa, Homo sapiens; identical to SEQ ID NO: 8048
  Light chain

SEQ ID NO: 8387 - protein, 108 aa, Homo sapiens; identical to SEQ ID NO: 3
  Light chain

SEQ ID NO: 8388 - protein, 108 aa, Homo sapiens
  Light chain
EIVLTQSPATLSLSPGERATLSCGASQSVSSNYLAWYQQKPGLAPRLLIYDASSRATGIPDRFSGSGSGTDFTLTISRLEPEDFAMYYCQQYGGSPWTFGQGTKVEIK

SEQ ID NO: 8389 - protein, 108 aa, Homo sapiens; identical to SEQ ID NO: 3
  Light chain

SEQ ID NO: 8390 - protein, 108 aa, Homo sapiens; identical to SEQ ID NO: 8048
  Light chain

SEQ ID NO: 8391 - protein, 108 aa, Homo sapiens; identical to SEQ ID NO: 8048
  Light chain

SEQ ID NO: 8392 - protein, 107 aa, Homo sapiens; identical to SEQ ID NO: 6
  Light chain

SEQ ID NO: 8393 - protein, 112 aa, Homo sapiens
  Light chain
DVVMTQSPLSLPVTLGQSASISCRSSQSLVYSDGNTYLNWFQQRPGQSPRRLIYKVSNRDSGVPDRFSGSGSGTDFTLKISRVEAEDVGVYYCMQGTHWPITFGQGTRLEIK

SEQ ID NO: 8394 - protein, 108 aa, Homo sapiens; identical to SEQ ID NO: 23
  Light chain

SEQ ID NO: 8395 - protein, 108 aa, Homo sapiens; identical to SEQ ID NO: 3
  Light chain

SEQ ID NO: 8396 - protein, 112 aa, Homo sapiens; identical to SEQ ID NO: 21
  Light chain

SEQ ID NO: 8397 - protein, 108 aa, Homo sapiens
  Light chain
EIVLTQSPGTLSLSPGERATLSCRASQSVSSSYLAWYQQKPGQAPRLLIYGASSRATGIPDRFSGSGSGTDFTLTISRLEPEDFAVYYCQQYGTSPWTFGQGTKVEVK

SEQ ID NO: 8398 - protein, 107 aa, Homo sapiens; identical to SEQ ID NO: 24
  Light chain

SEQ ID NO: 8399 - protein, 108 aa, Homo sapiens; identical to SEQ ID NO: 8048
  Light chain

SEQ ID NO: 8400 - protein, 107 aa, Homo sapiens
  Light chain
DIQMTQSPSSLSASVGDRVTITCRASQGISNYLAWYQQKPGKVPKLLIYAASTLQSGVPSRFSGSGSGTDFTLTISSLQPEDVATYYCQKYNSAPFTFGQGTKLEIK

SEQ ID NO: 8401 - protein, 107 aa, Homo sapiens; identical to SEQ ID NO: 6
  Light chain

SEQ ID NO: 8402 - protein, 108 aa, Homo sapiens
  Light chain
EIVLTQSPGTLSLSPGERATLSCRASQSVSSNFLAWFQQKPGQAPRLLIYGASSRATGIPDRFSGSGSGTDFTLTISRLEPEDFAVYYCQHYGSSPFTFGPGTKVDIK

SEQ ID NO: 8403 - protein, 107 aa, Homo sapiens; identical to SEQ ID NO: 8014
  Light chain

SEQ ID NO: 8404 - protein, 107 aa, Homo sapiens; identical to SEQ ID NO: 24
  Light chain

SEQ ID NO: 8405 - protein, 108 aa, Homo sapiens; identical to SEQ ID NO: 2
  Light chain

SEQ ID NO: 8406 - protein, 107 aa, Homo sapiens; identical to SEQ ID NO: 6
  Light chain

SEQ ID NO: 8407 - protein, 108 aa, Homo sapiens; identical to SEQ ID NO: 8048
  Light chain

SEQ ID NO: 8408 - protein, 108 aa, Homo sapiens; identical to SEQ ID NO: 8048
  Light chain

SEQ ID NO: 8409 - protein, 107 aa, Homo sapiens; identical to SEQ ID NO: 8001
  Light chain

SEQ ID NO: 8410 - protein, 108 aa, Homo sapiens; identical to SEQ ID NO: 2
  Light chain

SEQ ID NO: 8411 - protein, 108 aa, Homo sapiens; identical to SEQ ID NO: 8256
  Light chain

SEQ ID NO: 8412 - protein, 108 aa, Homo sapiens
  Light chain
EIVLTQSPGTLSLSPGERATLSCRASQSGSSSYLAWYQQKPGQAPRLLIYGASSRATGIPDRFSGSGSGTDFTLTISRLEPEDFAVYYCQQYGTSPFTFGPGTKVDIK

SEQ ID NO: 8413 - protein, 108 aa, Homo sapiens; identical to SEQ ID NO: 8412
  Light chain

SEQ ID NO: 8414 - protein, 108 aa, Homo sapiens; identical to SEQ ID NO: 8048
  Light chain

SEQ ID NO: 8415 - protein, 108 aa, Homo sapiens; identical to SEQ ID NO: 3
  Light chain

SEQ ID NO: 8416 - protein, 107 aa, Homo sapiens; identical to SEQ ID NO: 11
  Light chain

SEQ ID NO: 8417 - protein, 108 aa, Homo sapiens; identical to SEQ ID NO: 3
  Light chain

SEQ ID NO: 8418 - protein, 107 aa, Homo sapiens; identical to SEQ ID NO: 8249
  Light chain

SEQ ID NO: 8419 - protein, 107 aa, Homo sapiens; identical to SEQ ID NO: 6
  Light chain

SEQ ID NO: 8420 - protein, 107 aa, Homo sapiens
  Light chain
DIQMTQSPSSLSASVGDRVTITCRASQGISNYLAWYQQKPGKVPKLLIYAASTLQSGVPSRFSGSGSGTDFTLTISSLQPEDVATYYCQVYNSAPYTFGQGTKLEIK

SEQ ID NO: 8421 - protein, 108 aa, Homo sapiens
  Light chain
EIVMTQSPATLSLSPGERATLSCRASQSVSSSYLSWYQQKPGQAPRLLIYGASTRATGIPARFSGSGSGTDFTLTISSLQPEDFAVYYCQQGYNLPFTFGPGTKVDIK

SEQ ID NO: 8422 - protein, 108 aa, Homo sapiens; identical to SEQ ID NO: 3
  Light chain

SEQ ID NO: 8423 - protein, 108 aa, Homo sapiens
  Light chain
DIQMTQSPSSLSASVGDRVTITCRASQGISNYLAWYQQKPGKVPKLLIYAASTLQSGVPSRFSGSGSGTDFTLTISSLQPEDVATYYCQKYNSAPPLTFGGGTKVEIK

SEQ ID NO: 8424 - protein, 108 aa, Homo sapiens
  Light chain
EIVMTQSPATLSLSPGERATLSCRASQSFSSSYLSWFQQKPGQAPRLLISGASTRATGIPARFSGSGSGTDFTLTISSLQPEDFAVYYCQQVYNLPWTFGQGTKVEIK

SEQ ID NO: 8425 - protein, 108 aa, Homo sapiens; identical to SEQ ID NO: 8256
  Light chain

SEQ ID NO: 8426 - protein, 108 aa, Homo sapiens; identical to SEQ ID NO: 2
  Light chain

SEQ ID NO: 8427 - protein, 108 aa, Homo sapiens; identical to SEQ ID NO: 2
  Light chain

SEQ ID NO: 8428 - protein, 108 aa, Homo sapiens; identical to SEQ ID NO: 3
  Light chain

SEQ ID NO: 8429 - protein, 108 aa, Homo sapiens; identical to SEQ ID NO: 2
  Light chain

SEQ ID NO: 8430 - protein, 108 aa, Homo sapiens
  Light chain
EIVLTQSPGTLSLSPGERATLSCRASQSVFSSYLAWYQQKPGQAPRLLIYGASSRATGIPDRFSGSGSGTDFTLTISRLEPEDFAVYYCQQYGTSPYTFGQGTKLEIK

SEQ ID NO: 8431 - protein, 107 aa, Homo sapiens; identical to SEQ ID NO: 24
  Light chain

SEQ ID NO: 8432 - protein, 108 aa, Homo sapiens; identical to SEQ ID NO: 8048
  Light chain

SEQ ID NO: 8433 - protein, 108 aa, Homo sapiens; identical to SEQ ID NO: 8048
  Light chain

SEQ ID NO: 8434 - protein, 108 aa, Homo sapiens; identical to SEQ ID NO: 8048
  Light chain

SEQ ID NO: 8435 - protein, 108 aa, Homo sapiens; identical to SEQ ID NO: 8256
  Light chain

SEQ ID NO: 8436 - protein, 108 aa, Homo sapiens; identical to SEQ ID NO: 3
  Light chain

SEQ ID NO: 8437 - protein, 108 aa, Homo sapiens; identical to SEQ ID NO: 8256
  Light chain

SEQ ID NO: 8438 - protein, 107 aa, Homo sapiens
  Light chain
DIQMTQSPSSLSASVGDRVTITCRASQGISNYLAWYQQKPGKVPKLLIYAASTLQSGVPSRFSGSGSGTDFTLTISSLQPEDVATYYCQEYSSAPWTFGQGTKVEIK

SEQ ID NO: 8439 - protein, 108 aa, Homo sapiens; identical to SEQ ID NO: 8048
  Light chain

SEQ ID NO: 8440 - protein, 108 aa, Homo sapiens
  Light chain
EIVMTQSPATLSLSPGERATLSCRASQSVSSSYLSWYQQKPGQAPRLLIYGASTRATGIPARFSGSGSETDFTLTISSLQPEDFAVYYCQQVYNLPFTFGPGTKVDIK

SEQ ID NO: 8441 - protein, 108 aa, Homo sapiens
  Light chain
EIVLTQSPGTLSLSPGERATLSCRASQSVSSSYLAWYQQKPGQAPRLLIYGASSRATGIPDRFSGSGSGTDFTLTISRLEPEDFAVYYCQKYGSSPFTFGQGTKLEIK

SEQ ID NO: 8442 - protein, 108 aa, Homo sapiens
  Light chain
EIVLTQSPATLSLSPGERATLSCRASQSVSSYLAWYQQKPGQAPRLLIYDASNRATGIPARFSGSGSGTDFTLTISSLEPEDFAVYYCQQRSNWPPYTFGQGTKLEIK

SEQ ID NO: 8443 - protein, 108 aa, Homo sapiens; identical to SEQ ID NO: 3
  Light chain

SEQ ID NO: 8444 - protein, 108 aa, Homo sapiens; identical to SEQ ID NO: 3
  Light chain

SEQ ID NO: 8445 - protein, 108 aa, Homo sapiens; identical to SEQ ID NO: 3
  Light chain

SEQ ID NO: 8446 - protein, 108 aa, Homo sapiens; identical to SEQ ID NO: 3
  Light chain

SEQ ID NO: 8447 - protein, 108 aa, Homo sapiens; identical to SEQ ID NO: 8048
  Light chain

SEQ ID NO: 8448 - protein, 108 aa, Homo sapiens
  Light chain
EIVMTQSPATLSLSPGERATLSCRASQSGSSSYLSWYQQKPGQAPRLLIYGASTRATGIPARFSGSGSGTDFTLTISSLQPEDFAVYYCHQDYNLPYTFGQGTKLEIK

SEQ ID NO: 8449 - protein, 106 aa, Homo sapiens; identical to SEQ ID NO: 8
  Light chain

SEQ ID NO: 8450 - protein, 108 aa, Homo sapiens; identical to SEQ ID NO: 3
  Light chain

SEQ ID NO: 8451 - protein, 108 aa, Homo sapiens; identical to SEQ ID NO: 2
  Light chain

SEQ ID NO: 8452 - protein, 106 aa, Homo sapiens; identical to SEQ ID NO: 8
  Light chain

SEQ ID NO: 8453 - protein, 108 aa, Homo sapiens; identical to SEQ ID NO: 3
  Light chain

SEQ ID NO: 8454 - protein, 107 aa, Homo sapiens; identical to SEQ ID NO: 16
  Light chain

SEQ ID NO: 8455 - protein, 108 aa, Homo sapiens
  Light chain
EIVLTQSPATLSLSPGERATLSCGASQSVSSSYLAWYQQKPGLAPRLLIYDTSSRATGIPDRFSGSGSGTDFTLTITRLEPEDFAVYYCQQYGRSPWTFGQGTKVEIK

SEQ ID NO: 8456 - protein, 108 aa, Homo sapiens
  Light chain
EIVLTQSPGTLSLSPGERATLSCRASQSVSSSYLAWYQQKPGQAPRLLIYGSSSRATGIPDRFSGSGSGTDFTLTISRLEPEDFAVYYCQHYGSSPFTFGPGTKVDIK

SEQ ID NO: 8457 - protein, 112 aa, Homo sapiens; identical to SEQ ID NO: 21
  Light chain

SEQ ID NO: 8458 - protein, 108 aa, Homo sapiens; identical to SEQ ID NO: 8288
  Light chain

SEQ ID NO: 8459 - protein, 108 aa, Homo sapiens; identical to SEQ ID NO: 8455
  Light chain

SEQ ID NO: 8460 - protein, 109 aa, Homo sapiens; identical to SEQ ID NO: 19
  Light chain

SEQ ID NO: 8461 - protein, 109 aa, Homo sapiens
  Light chain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSTMYTFGQGTKLEIK

SEQ ID NO: 8462 - protein, 107 aa, Homo sapiens; identical to SEQ ID NO: 8014
  Light chain

SEQ ID NO: 8463 - protein, 108 aa, Homo sapiens; identical to SEQ ID NO: 8288
  Light chain

SEQ ID NO: 8464 - protein, 106 aa, Homo sapiens; identical to SEQ ID NO: 8
  Light chain

SEQ ID NO: 8465 - protein, 106 aa, Homo sapiens; identical to SEQ ID NO: 8
  Light chain

SEQ ID NO: 8466 - protein, 106 aa, Homo sapiens; identical to SEQ ID NO: 8
  Light chain

SEQ ID NO: 8467 - protein, 106 aa, Homo sapiens; identical to SEQ ID NO: 8
  Light chain

SEQ ID NO: 8468 - protein, 108 aa, Homo sapiens; identical to SEQ ID NO: 12
  Light chain

SEQ ID NO: 8469 - protein, 108 aa, Homo sapiens; identical to SEQ ID NO: 3
  Light chain

SEQ ID NO: 8470 - protein, 106 aa, Homo sapiens; identical to SEQ ID NO: 8
  Light chain

SEQ ID NO: 8471 - protein, 106 aa, Homo sapiens; identical to SEQ ID NO: 8
  Light chain

SEQ ID NO: 8472 - protein, 108 aa, Homo sapiens; identical to SEQ ID NO: 8456
  Light chain

SEQ ID NO: 8473 - protein, 108 aa, Homo sapiens; identical to SEQ ID NO: 8442
  Light chain

SEQ ID NO: 8474 - protein, 106 aa, Homo sapiens; identical to SEQ ID NO: 8
  Light chain

SEQ ID NO: 8475 - protein, 108 aa, Homo sapiens; identical to SEQ ID NO: 3
  Light chain

SEQ ID NO: 8476 - protein, 106 aa, Homo sapiens; identical to SEQ ID NO: 8
  Light chain

SEQ ID NO: 8477 - protein, 107 aa, Homo sapiens
  Light chain
DIQMTQSPSSLSASVGDRVTITCRASQRISSYLDWYQQKPGKAPKLLIYAASSLQSGVPSRFSGSGSGTDFTLTISSLQPEDFATYYCQQSYTTPLTFGGGTKVEIE

SEQ ID NO: 8478 - protein, 106 aa, Homo sapiens; identical to SEQ ID NO: 8
  Light chain

SEQ ID NO: 8479 - protein, 108 aa, Homo sapiens; identical to SEQ ID NO: 12
  Light chain

SEQ ID NO: 8480 - protein, 108 aa, Homo sapiens; identical to SEQ ID NO: 2
  Light chain

SEQ ID NO: 8481 - protein, 108 aa, Homo sapiens
  Light chain
EIVLTQSPATLSLSPGERATLSCGASQSVNNRYLAWYQQKPGLAPRLLIYDASTRATGIPDRFSGSGSGTDFTLTISRLEPEDFAVYYCQQYGNSPWTFGQGTKVEIK

SEQ ID NO: 8482 - protein, 106 aa, Homo sapiens; identical to SEQ ID NO: 8
  Light chain

SEQ ID NO: 8483 - protein, 106 aa, Homo sapiens; identical to SEQ ID NO: 8
  Light chain

SEQ ID NO: 8484 - protein, 108 aa, Homo sapiens; identical to SEQ ID NO: 8288
  Light chain

SEQ ID NO: 8485 - protein, 108 aa, Homo sapiens; identical to SEQ ID NO: 3
  Light chain

SEQ ID NO: 8486 - protein, 108 aa, Homo sapiens; identical to SEQ ID NO: 8456
  Light chain

SEQ ID NO: 8487 - protein, 108 aa, Homo sapiens
  Light chain
EIVMTQSPATLSLSPGERATLSCRASQSVSSSYLSWYQQKPGQAPRLLIYGASTRATGIPARFSGSGSGTDFTLTISSLQPEDFAVYYCQQDYNLPLTFGGGTKVEIK

SEQ ID NO: 8488 - protein, 108 aa, Homo sapiens; identical to SEQ ID NO: 2
  Light chain

SEQ ID NO: 8489 - protein, 108 aa, Homo sapiens; identical to SEQ ID NO: 2
  Light chain

SEQ ID NO: 8490 - protein, 106 aa, Homo sapiens; identical to SEQ ID NO: 8
  Light chain

SEQ ID NO: 8491 - protein, 108 aa, Homo sapiens; identical to SEQ ID NO: 2
  Light chain

SEQ ID NO: 8492 - protein, 108 aa, Homo sapiens
  Light chain
EIVLTQSPGTLSLSPGERATLSCGASQSVGSNYFAWYQQKPGQAPRLLIYGASSRATGIPDRFSGSGSGTDFTLTISRLETEDFAVFYCQHYGSSPWTFGQGTKVEIK

SEQ ID NO: 8493 - protein, 108 aa, Homo sapiens; identical to SEQ ID NO: 8288
  Light chain

SEQ ID NO: 8494 - protein, 108 aa, Homo sapiens; identical to SEQ ID NO: 2
  Light chain

SEQ ID NO: 8495 - protein, 108 aa, Homo sapiens; identical to SEQ ID NO: 8455
  Light chain

SEQ ID NO: 8496 - protein, 122 aa, Homo sapiens
  Heavy chain
QVQLQESGPGLVKPSETLSLTCTVSGGSISSYYWSWIRQPLGKGLEWIAYIYYTGSTNYNPSLKSRVTMSVDTSKNQFSLELSSVTAADTAVYYCARTLRYFDWLSSFDYWGQGTLVTVSSA

SEQ ID NO: 8497 - protein, 121 aa, Homo sapiens
  Heavy chain
QLQLQESGGGVVRPGGSLRLSCTVSGGSISSSSYYWGWIRQPPGKGLEWIGNIYYSGNTYYNPSLKSRVTISVDTSKNQFSLKLSSVTAADTAVYYCARRRIQLWSFDYWGQGTLVTVSSA

SEQ ID NO: 8498 - protein, 121 aa, Homo sapiens; identical to SEQ ID NO: 8497
  Heavy chain

SEQ ID NO: 8499 - protein, 121 aa, Homo sapiens; identical to SEQ ID NO: 8497
  Heavy chain

SEQ ID NO: 8500 - protein, 121 aa, Homo sapiens
  Heavy chain
QVQLVESGGGLVKPGGSLRLSCAASGFTFSDYYMSWVRQAPGKGLEWVAVISYDGSNKYYADSVKGRFTISRDNSKNTLYLQMNSLRAEDTAVYYCARWGSGSYYNGGLLGPGNPGHRLLS

SEQ ID NO: 8501 - protein, 121 aa, Homo sapiens; identical to SEQ ID NO: 8497
  Heavy chain

SEQ ID NO: 8502 - protein, 121 aa, Homo sapiens; identical to SEQ ID NO: 8497
  Heavy chain

SEQ ID NO: 8503 - protein, 124 aa, Homo sapiens
  Heavy chain
QVQLQESGPGLVKPSETLSLTCTVSGGSISSYYWSWIRQPPGKGLEWIGYIYYSGSTKYNPSLKSRVTISRDNAKNSLYLQMNSLRAEDTALYHCAREGNWRNYYYYYGMDVWGQGTTVTVSSA

SEQ ID NO: 8504 - protein, 115 aa, Homo sapiens
  Heavy chain
EVQLVESGGGLVKPGGSLRLSCAASGFTFSNAWMSWVRQAPGKGLEWVGRIKSKTDGGTTDYAAPVKGRFTISRDDSKNTLYLQLNSLKIEDTAVYYCTIIAAAGHYWGQGTLVT

SEQ ID NO: 8505 - protein, 116 aa, Homo sapiens
  Heavy chain
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGWPSDYWGQGTLVTVSSA

SEQ ID NO: 8506 - protein, 121 aa, Homo sapiens; identical to SEQ ID NO: 8497
  Heavy chain

SEQ ID NO: 8507 - protein, 117 aa, Homo sapiens
  Heavy chain
EVQLVESGGGVVRPGGSLRLSCAASGFTFDDYGMSWVRQAPGKGLEWVSGINWNGGSTGYADSVKGRFTISRDNAKNSLYLQMNSLRAEDTALYHCARGDVDIVATFDYWGQGTLVT

SEQ ID NO: 8508 - protein, 121 aa, Homo sapiens; identical to SEQ ID NO: 8497
  Heavy chain

SEQ ID NO: 8509 - protein, 121 aa, Homo sapiens
  Heavy chain
EVQLVESGGGVVRPGGSLRLSCAASGFTFDDYGMSWVRQAPGKGLEWVSGINWNGGSTGYADSVKGRFTISRDNAKNSLYLQMNSLRAEDTALYHCAREDNWRNYYYYYGMDVWGQGTTVT

SEQ ID NO: 8510 - protein, 121 aa, Homo sapiens; identical to SEQ ID NO: 8497
  Heavy chain

SEQ ID NO: 8511 - protein, 121 aa, Homo sapiens; identical to SEQ ID NO: 8497
  Heavy chain

SEQ ID NO: 8512 - protein, 122 aa, Homo sapiens
  Heavy chain
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDQEYYYGSGSSNWFDPWGQGTLVT

SEQ ID NO: 8513 - protein, 115 aa, Homo sapiens; identical to SEQ ID NO: 8504
  Heavy chain

SEQ ID NO: 8514 - protein, 121 aa, Homo sapiens; identical to SEQ ID NO: 8497
  Heavy chain

SEQ ID NO: 8515 - protein, 124 aa, Homo sapiens
  Heavy chain
QVQLQESGPGLVKPSETLSLTCTVSGGSISSYYWSWIRQPPGKGLEWIAYIYYTGSTNYNPSLKSRVTMSVDNAKNSLYLQMNSLRAEDTALYHCAREDNWRNYYYYYGTDVWGQGTTVTVSSA

SEQ ID NO: 8516 - protein, 122 aa, Homo sapiens
  Heavy chain
QVQLQESGPGLVKPSETLSLTCTVSGGSISSYYWSWIRQPLGKGLEWIAYIYYTGSTNYNPSLKSRVTMSVDTSKNQFSLELSSVTAADTAVYYCARTRRYFDWLSSFDYWGQGTLVTVSSA

SEQ ID NO: 8517 - protein, 116 aa, Homo sapiens; identical to SEQ ID NO: 8505
  Heavy chain

SEQ ID NO: 8518 - protein, 115 aa, Homo sapiens; identical to SEQ ID NO: 8504
  Heavy chain

SEQ ID NO: 8519 - protein, 122 aa, Homo sapiens
  Heavy chain
QVQLQESGPGLVKPSETLSLTCTVSGGSISSYYWSWIRQPLGKGLEWIAYIYYTGSTNYNPSLKSRVTMSVDTSKNQFSLELSSVTAADTAVYYCARALRYFDWLSSFDYWGQGTLVTVSSA

SEQ ID NO: 8520 - protein, 116 aa, Homo sapiens
  Heavy chain
QVQLVQSGAEVKKPGASVKVSCKASGYTFTSYGISWVRQALGQGLEWMGWISAYNGNTNYAQKLQGRVTMTTDTSTSTAYMELRSLRSDDTAVYYCARRWPSDYWGQGTLVTVSSA

SEQ ID NO: 8521 - protein, 122 aa, Homo sapiens
  Heavy chain
QVQLQESGPGLVKPSETLSLTCTVSGGSISSYYWSWIRQPLGKGLEWIAYIYYTGSTNYNPSLKSRVTMSVDTSKNQFSLELSSVTAADTAVYYCARPLRYFDWLSSFDYWGQGTLVTVSSA

SEQ ID NO: 8522 - protein, 121 aa, Homo sapiens
  Heavy chain
EVQLVESGGGVVRPGGSLRLSCAASGFTFDDYGMSWVRQAPGKGLEWVSGINWNGGSTGYADSVKGRFTISRDNAKNSLYLQMNSLRAEDTALYHCASEDNWRNYYYYYGMDVWGQGTTVT

SEQ ID NO: 8523 - protein, 123 aa, Homo sapiens
  Heavy chain
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARPLTMVRGRAYFDYWGQGTLVTVSSA

SEQ ID NO: 8524 - protein, 121 aa, Homo sapiens; identical to SEQ ID NO: 8509
  Heavy chain

SEQ ID NO: 8525 - protein, 122 aa, Homo sapiens
  Heavy chain
QVQLQESGPGLVKPSETLSLTCTVSGGSISSYYWSWIRQPLGKGLEWIAYIYYTGSTNYNPSLKSRVTMSVDTSKNQFSLELSSVTAADTAVYYCARTLRYVDWLSSFDYWGQGTLVTVSSA

SEQ ID NO: 8526 - protein, 122 aa, Homo sapiens
  Heavy chain
QVQLQESGPGLVKPSETLSLTCTVSGGSISSYYWSWIRQPLGKGLEWIGYMYYSGSTNYNPSLKSRVTISVDTSKNQFSLKLSSVTAADTAVYYCARERYSSSWYRAFDIWGQGTMVTVSSA

SEQ ID NO: 8527 - protein, 116 aa, Homo sapiens; identical to SEQ ID NO: 8505
  Heavy chain

SEQ ID NO: 8528 - protein, 122 aa, Homo sapiens
  Heavy chain
QVQLQESGPGLVKPSETLSLTCTVSGGSISSYYWSWIRQPLGKGLEWIAYIYYTGSTNYNPSLKSRVTMSVDTSKNQFSLELSSVTAADTAVYYCASTLRYFDWLSSFDYWGQGTLVTVSSA

SEQ ID NO: 8529 - protein, 118 aa, Homo sapiens
  Heavy chain
QVQLQESGPGLVKPSETLSLTCTVSGGSISSYYWSWIRQPPGKGLEWIAYIYYTGSTNYNPSLKSRVTMSVDTSKNQFSLELSSVTAADTAVYYCARTVRYFDWLSSFDYWGQGTLVT

SEQ ID NO: 8530 - protein, 126 aa, Homo sapiens
  Heavy chain
QVQLVESGGGVVQPGRSLRLSCAASGFTFNNYGMHWVRQAPGKGLEWVTIIWHDGSNKYYADSVKGRFTISRDNSKNMLYLQMNSLRAEDTAVYYCARGRAYYYGSGSYYNFDYWGQGTLVTVSSA

SEQ ID NO: 8531 - protein, 112 aa, Homo sapiens
  Heavy chain
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARGWPYDYWGQGTLVT

SEQ ID NO: 8532 - protein, 121 aa, Homo sapiens; identical to SEQ ID NO: 8497
  Heavy chain

SEQ ID NO: 8533 - protein, 118 aa, Homo sapiens
  Heavy chain
QVQLQESGPGLVKPSETLSLTCTVSGGSISSYYWSWIRQPPGKGLEWIAYIYYTGSTNYNPSLKSRVTMSVDTSKNQFSLELSSVTAADTAVYYCAGTLRYFDWLSSFDYWGQGTLVT

SEQ ID NO: 8534 - protein, 115 aa, Homo sapiens; identical to SEQ ID NO: 8504
  Heavy chain

SEQ ID NO: 8535 - protein, 121 aa, Homo sapiens
  Heavy chain
EVQLVESGGGVVRPGGSLRLSCAASGFTFDDYGMSWVRQAPGKGLEWVSGINWNGGSTGYADSVKGRFTISRDNAKNSLYLQMNSLRAEDTALYHCAREDNWRNYYYSYGMDVWGQGTTVT

SEQ ID NO: 8536 - protein, 121 aa, Homo sapiens; identical to SEQ ID NO: 8497
  Heavy chain

SEQ ID NO: 8537 - protein, 121 aa, Homo sapiens; identical to SEQ ID NO: 8497
  Heavy chain

SEQ ID NO: 8538 - protein, 118 aa, Homo sapiens
  Heavy chain
QVQLQESGPGLVKPSETLSLTCTVSGGSISSYYWSWIRQPPGKGLEWIAYIYYTGSTNYNPSLKSRVTMSVDTSKNQFSLELSSVTAADTAVYYCARTLRDFDWLSSFDYWGQGTLVT

SEQ ID NO: 8539 - protein, 117 aa, Homo sapiens
  Heavy chain
QLQLQESGPGLVKPSETLSLTCTVSGGSISSSSYYWGWIRQPPGKGLEWIGNIYYSGNTYYNPSLKSRVTISVDTSKNQFSLKLSSVTAADTAVYYCARRRIQLWSFGYWGQGTLVT

SEQ ID NO: 8540 - protein, 121 aa, Homo sapiens; identical to SEQ ID NO: 8509
  Heavy chain

SEQ ID NO: 8541 - protein, 121 aa, Homo sapiens
  Heavy chain
EVQLVESGGGVVRPGGSLRLSCAASGFTFDDYGMSWVRQAPGKGLEWVSGINWNGGSTGYADSVKGRFTISRDNAKNSLYLQMNSLRAEDTALYHCAREDNWRKYYYYYGMDVWGQGTTVT

SEQ ID NO: 8542 - protein, 120 aa, Homo sapiens
  Heavy chain
QVQLVESGGGVVQPGRSLRLSCAASGFTFSSYGMHWVRQAPGKGLEWVAVIWYDGNNKHYADSVKGRFTISRDNSKNTLYLQMNSLRAEDTAVYYCARGDILTGYYGYWGQGTLVAVSSA

SEQ ID NO: 8543 - protein, 120 aa, Homo sapiens
  Heavy chain
QVQLVESGGGVVQPGRSLRLSCAASGFTFNSYGMHWVRQAPGKGLEWVAVIWYDGNNKHYADSVKGRFTISRDNSKNTLYLQMNSLRAEDTAVYYCVRGDILTGYYGYWGQGTLVTVSSA

SEQ ID NO: 8544 - protein, 119 aa, Homo sapiens
  Heavy chain
QVQLVESGGGVVQPGRSLRLSCAASGFTFSSYGIHWVRQAPGKGLEWVAVIWYDGRNKYYADSVKGRFTISRDNSKNTLYLQMNSLRAEDTAVYFCARGGQLGHFDYWGQGTLVTVSSA

SEQ ID NO: 8545 - protein, 119 aa, Homo sapiens
  Heavy chain
QVQLVESGGGVVQPGRSLRLSCAASGFTLSSYGMHWVRQAPGKGLEWVAVIWYDGSNKYYADSVKGRFTISRDNSKNTLYLQMSSLRAEDTAVYYCARVHQLGPFDYWGQGTLVTVSSA

SEQ ID NO: 8546 - protein, 120 aa, Homo sapiens
  Heavy chain
QLQLQESGPGLVKPSETLSLTCTVSGGSISSNSYYWGWIRQPPGEGLEWIGSIYYSGHTYYNPSLKSRVTISVDTPKNQFSLKLSSVTAADTAVYFCARMVRGLIINYWGQGTLVTVSSA

SEQ ID NO: 8547 - protein, 119 aa, Homo sapiens
  Heavy chain
QVQLVESGGGVVQPGRSLRLSCAASGFTFSTYGMHWVRLAPGKGLEWVAVIFNDGNNKYYADSVKGRFTISRDNSKNTLYLQMNSLRAEDTAMYYCARKGHLGPFDYWGQGTLVTVSSA

SEQ ID NO: 8548 - protein, 119 aa, Homo sapiens
  Heavy chain
QVQLVESGGGVVQPGRSLRLSCAASGFTFSSHGMHWVRQAPGKGLEWVAVTWYDGSNKYYADSVKGRFTISRDNSKNTLYLQMNSLRAEDTAVYYCARGDLRGWFDPWGQGTLVTVSSA

SEQ ID NO: 8549 - protein, 122 aa, Homo sapiens
  Heavy chain
QVQLVESGGGVVQPGRSLRLSCAASGFTFSSYGMHWVRQAPGKGLEWVAVIWYDGSNKYYADSVKGRFTISRDNSKNTLNLQMNSLRAEDTAVYYCAREGGSGWYEYLDLWGRGTLVSVSSA

SEQ ID NO: 8550 - protein, 120 aa, Homo sapiens
  Heavy chain
QVQLVESGGGVVQPGRSLRLSCAASGFTFNSYGMHWVRQAPGKGLEWVAVIWYDGNNKHYADSVKGRFTISRDNSKNTLYLQMNSLRAEDTAVYYCGRGDILTGYYGYWGQGTLVTVSSA

SEQ ID NO: 8551 - protein, 119 aa, Homo sapiens
  Heavy chain
QVQLVESGGGVVQPGRSLRLSCAASGFTLSRYGMHWVRQAPGKGLEWVAVTWYDGSNKNYADSVKGRFTISRDNSKNTLYLQMNSLRVEDTAVYYCTRVDWWGVFDFWGQGTLVTVSSA

SEQ ID NO: 8552 - protein, 119 aa, Homo sapiens
  Heavy chain
QVQLVESGGGVVQPGRSLRLSCAASGFTFRSFGMHWVRQAPGKGLEWVTAIWYDGNNKYYADSVKGRFTISRDNSKNTLYLQMNSLRAEDTAVYYCARGGQLGHFDFWGQGTLVTVSSA

SEQ ID NO: 8553 - protein, 119 aa, Homo sapiens
  Heavy chain
QVQLVESGGGVVQPGRSLRLSCAASGFTFSSYGMHWVRQAPGKGLEWVAVIWYDGSNKHYADSVKGRYTISRDNSKNTLYLQMNSLRAEDTALYYCARGGLIGPFDYWGQGTLVTVSSA

SEQ ID NO: 8554 - protein, 119 aa, Homo sapiens
  Heavy chain
QVQLVESGGGVVQPGRSLRLSCAASGFTFSRYGMHWVRQAPGKGLEWVAVIWYDGNNKYYADSVKGRFTISRDNSKNTLNLQMNSLRAEDTAVYYCARAGILTGLDYWGQGTLVTVSSA

SEQ ID NO: 8555 - protein, 119 aa, Homo sapiens; identical to SEQ ID NO: 8547
  Heavy chain

SEQ ID NO: 8556 - protein, 120 aa, Homo sapiens
  Heavy chain
QVQLVESGGGVVQPGRSLRLSCAASGFTFSSYGMHWVRQAPGKGLEWVAVIWYDGNNKHYADSVKGRFTISRDNSKNTLYLQMNSLRAEDTAVYYCARGDILTGYYSYWGQGTLVAVSSA

SEQ ID NO: 8557 - protein, 119 aa, Homo sapiens
  Heavy chain
QVQLVESGGGVVQPGRSLRLSCAASGFTFSSYGMNWVRQAPGKGLEWVAVIWYGGSNKYYTDSVKGRFTISRDNSKNTLYLQMNSLRAEDTAVYYCARVHLLGPFDYWGQGTLVTVSSA

SEQ ID NO: 8558 - protein, 121 aa, Homo sapiens
  Heavy chain
QVQLVESGGGVVQPGRSLRLSCAASGFTFSSYGMHWVRQAPGKGLEWVAVIWYDGNNRYYADSVKGRFTISRDNSKNTLYLQMNSLRAEDTAVYYCARGLLWFGESLDYWGLGTLVTVSSA

SEQ ID NO: 8559 - protein, 119 aa, Homo sapiens
  Heavy chain
QVQLVESGGGVVQPGRSLRLSCAASGFTFSRFGVNWVRQAPGKGLEWVAVIWYDGSNKYYADSVKGRFTISRDNSKNTLFLQMNSLRAEDTAVYYCARVPQLGPFDYWGQGTLVTVSSA

SEQ ID NO: 8560 - protein, 119 aa, Homo sapiens
  Heavy chain
QVQLVESGGGVVQPGRSLRLSCAASGFTLSRYGMHWVRQAPGKGLEWVAVTWYDGSNKNYADSVKGRFTISRDNSKNTLYLQMNSLRVEDTAVYYCTRVDWWGAFDFWGQGTLVTVSSA

SEQ ID NO: 8561 - protein, 122 aa, Homo sapiens
  Heavy chain
QVQLVESGGGVVQPGRSLRLSCAASGFTFSSYGMHWVRQAPGKGLEWVAVIWYDGSNKYYADSVKGRFTISRDNSKNTLNLQMNSLRAEDTAVYYCAREGGSGWYEYIDLWGRGTLVSVSSA

SEQ ID NO: 8562 - protein, 121 aa, Homo sapiens
  Heavy chain
QVQLVESGGGVVQPGRSLRLSCAASGFTFSNYCMHWVRQAPGKGLEWVAVIWYDGRNKYYADSVKGRFTISRDNSKSTLYLQMNSLRAEDTAVYYCSRGLLWFGESLDYWGQGTLVTVSSA

SEQ ID NO: 8563 - protein, 120 aa, Homo sapiens
  Heavy chain
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARGDILTGYYDYWGQGTLVTVSSA

SEQ ID NO: 8564 - protein, 120 aa, Homo sapiens
  Heavy chain
QVQLVESGGGVVQPGRSLRLSCAASGFTFNSYGMHWVRQAPGKGLEWVAVIWYDGNNKHYADSVKGRFTISRDNSKNTLYLQMNSLRAEDTAVYYCVRGDILTGYYSYWGQGTLVTVSSA

SEQ ID NO: 8565 - protein, 120 aa, Homo sapiens; identical to SEQ ID NO: 8543
  Heavy chain

SEQ ID NO: 8566 - protein, 119 aa, Homo sapiens; identical to SEQ ID NO: 8545
  Heavy chain

SEQ ID NO: 8567 - protein, 120 aa, Homo sapiens; identical to SEQ ID NO: 8543
  Heavy chain

SEQ ID NO: 8568 - protein, 120 aa, Homo sapiens
  Heavy chain
QVQLVESGGGVVQPGRSLRLSCAASGFTFSSYGMHWVRQAPGKGLEWVAVIWYDGNNKHYADSVKGRFTISRDNSKNTLYLQMNSLRAEDTAVYYCARGDMLTGYYGYWGQGTLVAVSSA

SEQ ID NO: 8569 - protein, 119 aa, Homo sapiens
  Heavy chain
QVQLVESGGGVVQPGRSLRLSCAASGFTFSRFGVNWVRQAPGKGLEWVAVIWYDGSNKYYADSVKGRFTISRDNSKNTLFLQMNSLRAEDTAVYYCARVHQLGPFDSWGQGTLVTVSSA

SEQ ID NO: 8570 - protein, 119 aa, Homo sapiens; identical to SEQ ID NO: 8545
  Heavy chain

SEQ ID NO: 8571 - protein, 120 aa, Homo sapiens; identical to SEQ ID NO: 8542
  Heavy chain

SEQ ID NO: 8572 - protein, 120 aa, Homo sapiens
  Heavy chain
QVQLVESGGGVVQPGRSLRLSCAASGFTFSSYGMHWVRQAPGKGLEWVAVIWYDGNNKHYADSVKGRFTISRDNSKNTLYLQMNSLRAEDTAVYYCARGDILTGYYGSWGQGTLVAVSSA

SEQ ID NO: 8573 - protein, 119 aa, Homo sapiens
  Heavy chain
QVQLVESGGGVVQPGRSLRLSCAASGFTFRSFGMHWVRQAPGKGLEWVAAVWYDGSNKYFADSVKGRFTITRDNSKNTLYLQMNSLRAEDTAVYYCARGGHLGHFDYWGQGTLVTVSSA

SEQ ID NO: 8574 - protein, 120 aa, Homo sapiens; identical to SEQ ID NO: 8543
  Heavy chain

SEQ ID NO: 8575 - protein, 119 aa, Homo sapiens; identical to SEQ ID NO: 8544
  Heavy chain

SEQ ID NO: 8576 - protein, 119 aa, Homo sapiens
  Heavy chain
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARGAILTGFDYWGQGTLVTVSSA

SEQ ID NO: 8577 - protein, 119 aa, Homo sapiens
  Heavy chain
QVQLVESGGGVVQPGRSLRLSCAASGFTFSSYGMHWVRQAPGKGLEWVAFIWDDGRNKYYADSVKGRFTISRDNSKNTLFLQMNSLRAEDTAVYYCARKGQLGPFDYWGQGTLVTVSSA

SEQ ID NO: 8578 - protein, 120 aa, Homo sapiens
  Heavy chain
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARRSSSWYYFDYWGQGTLVTVSSA

SEQ ID NO: 8579 - protein, 122 aa, Homo sapiens
  Heavy chain
QVQLVESGGGVVQPGRSLRLSCAASGITFSSYGMHWVRQAPGKGLEWVAVIWYDGSNKYYADSVKGRFTISRDNSKNTLYLQMNSLRAEDTAVYYCAREGGSGWYEYLDLWGRGTLVTVSSA

SEQ ID NO: 8580 - protein, 119 aa, Homo sapiens; identical to SEQ ID NO: 8577
  Heavy chain

SEQ ID NO: 8581 - protein, 119 aa, Homo sapiens
  Heavy chain
QVQLVESGGGVVQPGRSLRLSCAASGFTFSSYGMHWVRQAPGKGLEWVAALWYDGSNKYYADSVKGRFTISRDNSKNTLYLQMNSLRAEDTAVYYCTRGDYFGFWDYWGQGTLVTVSSA

SEQ ID NO: 8582 - protein, 119 aa, Homo sapiens; identical to SEQ ID NO: 8577
  Heavy chain

SEQ ID NO: 8583 - protein, 125 aa, Homo sapiens
  Heavy chain
QLQLQESGPGLVKPSETLSLTCTVSGGSISSSSYYWGWIRQPPGKGLEWIGSIYYSGSTYYNPSLKSRVTISVDTSKNQFSLELSSVAAADTAVYYCARVSYYYGSGSYYFDYWGQGTLVTVSSA

SEQ ID NO: 8584 - protein, 129 aa, Homo sapiens
  Heavy chain
QLQLQESGPGLVKPSETLSLTCTVSGGSISSSSYYWGWIRQPPGKGLEWIGSIYYSGSTYYNPSLKSRVTISVDTSKNQFSLNLNSVTAADTAVYYCAGFYYGSGSRYYYYYYGMDVWGQGTTVTVSSA

SEQ ID NO: 8585 - protein, 122 aa, Homo sapiens
  Heavy chain
QVQLVESGGGVVQPGRSLRLSCAASGITFSSYGMHWVRQAPGKGLEWVAVIWYDGSNKYYADSVKGRFTISRDNSKNTLYLQMNSLRAEDTAVYYCAREGGSGWYEYIDLWGRGTLVTVSSA

SEQ ID NO: 8586 - protein, 119 aa, Homo sapiens
  Heavy chain
QVQLVESGGGVVQPGRSLRLSCAASGVTLSSYGMHWVRQAPGKGLEWVAVIWYDGRNKYYADSVKGRFTISRDNSKNTLYLQMNSLRAEDTAVYYCARVHQLGPFDYWGQGTLVTVSSA

SEQ ID NO: 8587 - protein, 120 aa, Homo sapiens; identical to SEQ ID NO: 8578
  Heavy chain

SEQ ID NO: 8588 - protein, 125 aa, Homo sapiens; identical to SEQ ID NO: 8583
  Heavy chain

SEQ ID NO: 8589 - protein, 119 aa, Homo sapiens
  Heavy chain
QVQLVESGRGIVQPGRSLRLSCAASGFTFSSYGMHWVRQSPGKGLDWVAFIWDDGINKYYADSVKGRFTISRDNSKNTLYLQMNSLRAEDTAVYYCARKGQLGSFDYWGQGTLVTVSSA

SEQ ID NO: 8590 - protein, 120 aa, Homo sapiens; identical to SEQ ID NO: 8578
  Heavy chain

SEQ ID NO: 8591 - protein, 125 aa, Homo sapiens; identical to SEQ ID NO: 8583
  Heavy chain

SEQ ID NO: 8592 - protein, 120 aa, Homo sapiens
  Heavy chain
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARRSSSWYYFYYWGQGTLVTVSSA

SEQ ID NO: 8593 - protein, 119 aa, Homo sapiens
  Heavy chain
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARGAILTGFDSWGQGTLVTVSSA

SEQ ID NO: 8594 - protein, 125 aa, Homo sapiens; identical to SEQ ID NO: 8583
  Heavy chain

SEQ ID NO: 8595 - protein, 122 aa, Homo sapiens
  Heavy chain
QVQLVESGGGVVQPGRSLRLSCAASGITFSSYGMHWVRQAPGKGLEWVAVIWYDGSNKYYADSVKGRFTISRDNSKNTLYLQMNSLRAEDTAVYYCARDGGSGWYEYLDLWGRGTLVTVSSA

SEQ ID NO: 8596 - protein, 120 aa, Homo sapiens; identical to SEQ ID NO: 8578
  Heavy chain

SEQ ID NO: 8597 - protein, 120 aa, Homo sapiens; identical to SEQ ID NO: 8578
  Heavy chain

SEQ ID NO: 8598 - protein, 118 aa, Homo sapiens
  Heavy chain
QVQLVESGGGVVQPGRSLRLSCAASGFTFSSYNMHWVRQAPGKGLEWVAVIGYDGSDKYYADSVKGRFTISRDNSKNTLYLQMNSLRAEDTAVYYCAREKHWFFDLWGRGTLVTVSSA

SEQ ID NO: 8599 - protein, 125 aa, Homo sapiens; identical to SEQ ID NO: 8583
  Heavy chain

SEQ ID NO: 8600 - protein, 125 aa, Homo sapiens
  Heavy chain
QLQLQESGPGLVKPSETLSLTCTVSGGSISSSSYYWGWIRQPPGKGLEWIGSIYYSGSTYYNPSLKSRVTISVDTSKNQFSLELSSVAAADTAVYYCARVSYSYGSGSYYFDYWGQGTLVTVSSA

SEQ ID NO: 8601 - protein, 120 aa, Homo sapiens
  Heavy chain
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARRSSGWYYFDYWGQGTLVTVSSA

SEQ ID NO: 8602 - protein, 121 aa, Homo sapiens
  Heavy chain
EVQLVESGGGLVQPGRSLRLSCTASGFTFGDYVVSWFRQAPGKGLEWVGFIRRKAYGGTTAYAASVKGRFSISRDDSKNIAYLQMNSLKTEDTAVYYCTRSGWYWYFDLWGRGTLVTVSSA

SEQ ID NO: 8603 - protein, 124 aa, Homo sapiens
  Heavy chain
EVQLVESGPGLVKPSETLSPTCTVSGGSISSYYWSWIRQPPGKGLEWIGYIYYSGSTNYNPSLKSRVTISVDTSKNQLSLKLSSVTAADTALYHCAREDNWRNYYYYYGMDVWGQGTTVTVSSA

SEQ ID NO: 8604 - protein, 125 aa, Homo sapiens; identical to SEQ ID NO: 8583
  Heavy chain

SEQ ID NO: 8605 - protein, 125 aa, Homo sapiens; identical to SEQ ID NO: 8583
  Heavy chain

SEQ ID NO: 8606 - protein, 119 aa, Homo sapiens
  Heavy chain
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARGAIFTGFDYWGQGTLVTVSSA

SEQ ID NO: 8607 - protein, 129 aa, Homo sapiens; identical to SEQ ID NO: 8584
  Heavy chain

SEQ ID NO: 8608 - protein, 125 aa, Homo sapiens; identical to SEQ ID NO: 8583
  Heavy chain

SEQ ID NO: 8609 - protein, 119 aa, Homo sapiens; identical to SEQ ID NO: 8577
  Heavy chain

SEQ ID NO: 8610 - protein, 119 aa, Homo sapiens
  Heavy chain
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARGAILTGFDVWGQGTTVTVSSA

SEQ ID NO: 8611 - protein, 120 aa, Homo sapiens
  Heavy chain
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARGSSRYWYFDLWGRGTLVTVSSA

SEQ ID NO: 8612 - protein, 120 aa, Homo sapiens; identical to SEQ ID NO: 8578
  Heavy chain

SEQ ID NO: 8613 - protein, 120 aa, Homo sapiens; identical to SEQ ID NO: 8601
  Heavy chain

SEQ ID NO: 8614 - protein, 125 aa, Homo sapiens; identical to SEQ ID NO: 8583
  Heavy chain

SEQ ID NO: 8615 - protein, 119 aa, Homo sapiens
  Heavy chain
QVQLVESGRGIVQPGRSLRLSCAASGFTFSSYGMHWVRQSPGKGLDWVAFIWDDGKNKYYADSVKGRFTISRDNSKNTLYLQMNSLRAEDTAVYYCARKGQLGPFDSWGQGTLVTVSSA

SEQ ID NO: 8616 - protein, 120 aa, Homo sapiens; identical to SEQ ID NO: 8578
  Heavy chain

SEQ ID NO: 8617 - protein, 119 aa, Homo sapiens; identical to SEQ ID NO: 8615
  Heavy chain

SEQ ID NO: 8618 - protein, 125 aa, Homo sapiens; identical to SEQ ID NO: 8600
  Heavy chain

SEQ ID NO: 8619 - protein, 120 aa, Homo sapiens; identical to SEQ ID NO: 8578
  Heavy chain

SEQ ID NO: 8620 - protein, 120 aa, Homo sapiens; identical to SEQ ID NO: 8578
  Heavy chain

SEQ ID NO: 8621 - protein, 125 aa, Homo sapiens; identical to SEQ ID NO: 8583
  Heavy chain

SEQ ID NO: 8622 - protein, 129 aa, Homo sapiens; identical to SEQ ID NO: 8584
  Heavy chain

SEQ ID NO: 8623 - protein, 119 aa, Homo sapiens
  Heavy chain
QVQLVESGGGVVQPGRSLRLSCAASGFTFSSYGMHWVRQAPGKGLEWVAFIWDDGRNKYYADSVKGRFTISRDNSKNTLFLQMNSLRAEDTAVYYCARNGQLGPFDYWGQGTLVTVSSA

SEQ ID NO: 8624 - protein, 130 aa, Homo sapiens
  Heavy chain
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCAGYYYGSGSPLYYYYYYGMDVWGQGTTVTVSSA

SEQ ID NO: 8625 - protein, 119 aa, Homo sapiens; identical to SEQ ID NO: 8577
  Heavy chain

SEQ ID NO: 8626 - protein, 120 aa, Homo sapiens; identical to SEQ ID NO: 8578
  Heavy chain

SEQ ID NO: 8627 - protein, 119 aa, Homo sapiens
  Heavy chain
QVQLVESGGGVVQPGRSLRLSCAASGFTFSSYGIHWVRQAPGKGLEWVAVIWYDGRNKYYADSVKGRFTISRDNSKNTLYLQMNSLRAEDTAVYYCARAGNWGPFDYWGQGTLVTVSSA

SEQ ID NO: 8628 - protein, 119 aa, Homo sapiens
  Heavy chain
EVQLVESGGGVVRPGGSLRLSCAASGFTFDDYGMSWVRQAPGKGLEWVSGINWNGGSTGYADSVKGRFAISRDNAKNSLYLQMNSLRAEDTALYHCVRDGWELLGDYWGQGTLVTVSSA

SEQ ID NO: 8629 - protein, 119 aa, Homo sapiens
  Heavy chain
EVQLVESGGGVVRPGGSLRLSCAASGFTFDDYGMSWVRQAPGKGLEWVSGINWNGGSTGYVDSVKGRFIISRDNAKNSLYLQMNSLRAEDTALYYCARDGWKLLDDYWGQGTLVTVSSA

SEQ ID NO: 8630 - protein, 117 aa, Homo sapiens
  Heavy chain
QVQLVQSGAEEKKPGAAVKVSCKASGYTFTSYGISWVRQAPGQGLEWMGWISAYNGNTHYAQKFQGRVTMTTDTSTSTAYMELRSLRSDDTAVYYCARVGPPFDYWGQGTLVTVSSA

SEQ ID NO: 8631 - protein, 119 aa, Homo sapiens
  Heavy chain
EVQLVESGGYVVRPGGSLRLSCAASGFAFDDFGMSWVRQPPGKGLEWVSGINWNGGNTGYVDSVKGRFIISRDNAKNSLYLQMNSLRAEDTALYYCVRDGWKLLDDYWGQGTLVTVSSA

SEQ ID NO: 8632 - protein, 119 aa, Homo sapiens
  Heavy chain
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARITGPYAFDIWGQGTKVTVSSA

SEQ ID NO: 8633 - protein, 118 aa, Homo sapiens
  Heavy chain
QVQLVQSGAEVKKPGASVKVSCKASGYTFTSYGISWVRQAPGQGLEWMGWISVYNGNTNYAQKLQGRVTMTTDTSTSTAYMELRSLRSDDTAVYYCARVGANWFDPWGQGTLVTVSSA

SEQ ID NO: 8634 - protein, 119 aa, Homo sapiens
  Heavy chain
QVQLVESGGGVVQPGRSLRLSCAASGFTFSSHGMDWVRQAPGKGLEWVAVIWYDGRNKYYADSVKGRFTISRDNSKNTLYLQMNSLRVEDTAVYYCARGGLIGGFDYWGQGTLVTVSSA

SEQ ID NO: 8635 - protein, 119 aa, Homo sapiens
  Heavy chain
QVQLVESGGGVVQPGRSLRLSCTASGFTFSSYGMDWVRQAPGKGLEWVAVIWYDGRNKYYADSVKGRFTISGDSSKNTLYLQMNSLRAEDTAVYYCARGGLLGGFDYWGQGTLVTVSSA

SEQ ID NO: 8636 - protein, 124 aa, Homo sapiens
  Heavy chain
QVQLVQSGAEVQKPGASVKVSCKASGYTFTSYYMHWVRQAPGQGLEWMGIINPSGGSSNYAQKFLGRVTMTRDTSTSTVYMELSGLRSEDTAVYYCARDPPITMVRGAPFDYWGQGTLVTVSSA

SEQ ID NO: 8637 - protein, 121 aa, Homo sapiens
  Heavy chain
QVQLVESGGGVVQPGRSLRLSCAASGFTFRGYGMHWVRQAPGKGLEWVAVIWNDGSNKYYADSVKGRFTISRDNSKNTLYLQMNSLRAEDTAVYYCARTYNWNDVGWDYWGQGTLVTVSSA

SEQ ID NO: 8638 - protein, 119 aa, Homo sapiens; identical to SEQ ID NO: 8635
  Heavy chain

SEQ ID NO: 8639 - protein, 124 aa, Homo sapiens; identical to SEQ ID NO: 8636
  Heavy chain

SEQ ID NO: 8640 - protein, 119 aa, Homo sapiens
  Heavy chain
QVQLVESGGGVVQPGRSLRLSCAASGFTFSSYGIHWVRQAPGKGLEWVAVILYDGSNKFYADSVKGRFTISRDNSKNTLYLQMNSLRAEDTAVYYCARGGLTGPFDYWGQGTLVTVSSA

SEQ ID NO: 8641 - protein, 119 aa, Homo sapiens
  Heavy chain
QVQLVESGGGVVQPGRSLRLSCAASGFTFSSYGIHWVRQAPGKGLEWVAVIWYDGSNKFYADSVKGRFTISRDTSKNTLYLQMNSLRAEDTAVYYCARGGIWGYFDYWGQGTLVTVSSA

SEQ ID NO: 8642 - protein, 119 aa, Homo sapiens
  Heavy chain
QVQLVESGGGVVQPGRSLRLSCAASGFTFNSYGMHWVRQAPGKGLEWVAVIWYDGSNKHYADSVEGRFTISRDNSKNTLYLQMNSLRAEDTAVYYCVRGGIWGYFDYWGQGTLVTVSSA

SEQ ID NO: 8643 - protein, 119 aa, Homo sapiens
  Heavy chain
QVQLVESGGGVVQPGRSLRLSCAASGFTFSNYGMHWVRQAPGKGLEWVAVIFYDGSNKYYADSVKGRFTISRDNSKNTLYLQMNSLRAEDTAVYYCARVGLLGGMDVWGQGTTVTVSSA

SEQ ID NO: 8644 - protein, 118 aa, Homo sapiens
  Heavy chain
QVQLVQSGPEVKKPGASVKVSCKASGYTFTNYGIGWVRQAPGQGLEWMGWISAYNGNTNYVQKFQGRVTMTTDPSTSTAYMALRSLRSDDTAVYYCARVGASGVDYWGQGTLVTVSSA

SEQ ID NO: 8645 - protein, 119 aa, Homo sapiens; identical to SEQ ID NO: 8627
  Heavy chain

SEQ ID NO: 8646 - protein, 118 aa, Homo sapiens
  Heavy chain
QVQLVQSGPEVKKPGASVKVSCKASGYTFTSYGIGWVRQAPGQGLEWMGWISAYNGNTNYVQKFQGRVTMTTDTSTNTAYMELRSPRSDDTAVYYCARVGSSGVDYWGQGTLVTVSSA

SEQ ID NO: 8647 - protein, 120 aa, Homo sapiens
  Heavy chain
QVQLVQSGAEVKKPGASVKVSCKASGYTFTNYGISWVRQAPGQGLEWMGWISAYNGNTNYAQKFQGRVTMTTDTSTSTAYMELRSLRSDDTAVYYCARGPSGPYEGDYWGQGTLVTVSSA

SEQ ID NO: 8648 - protein, 119 aa, Homo sapiens
  Heavy chain
QVQLVESGGGVVQPGRSLRISCAASGFTFSSYGIHWVRQAPGKGLEWVAVIWYDGRNKHYADSVKGRFTISRDNSKNTLYLQMNSLRAEDTAVYYCARAGILGGMDVWGQGTTVTVSSA

SEQ ID NO: 8649 - protein, 119 aa, Homo sapiens
  Heavy chain
EVQLVESGGGVVRPGGSLRLSCAASGFSFDDFGMSWVRQAPGKGLEWVSGINWNGGSTGYADSVKGRFTISRDNAKNSLYLQMNSLRAEDTALYHCTRDGWRLLDDYWGQGTLVTVSSA

SEQ ID NO: 8650 - protein, 119 aa, Homo sapiens; identical to SEQ ID NO: 8628
  Heavy chain

SEQ ID NO: 8651 - protein, 117 aa, Homo sapiens
  Heavy chain
EVQLVESGGDLVKPGGSLRLSCAASGFTFSYAWMSWVRQAPGKGLEWIGRIKSKTDGGTIDYAAPVKDRFIISRDDSKNTLYLQMNSLKTEDSAVYYCTEERMDYWGQGTLVTVSSA

SEQ ID NO: 8652 - protein, 121 aa, Homo sapiens
  Heavy chain
QVQLVESGGGVVQPGGSLRLSCAASGFTFRGYGMHWVRQAPGKGLEWVAIIWNDGSNRYYADSVKGRFTISRDNSKNTLYLQMNSLRAEDTAVYYCTRTYTWNDVGWDYWGQGTLVTVSSA

SEQ ID NO: 8653 - protein, 119 aa, Homo sapiens
  Heavy chain
QVQLVESGGGVVQPGRSLRLSCAASGFTFSSYGIHWVRQAPGKGLEWVAVIWYDGSNKHYADSVRGRFTISRDNSKNTLYLQMNSLRAEDTAIYYCARAGIWGPFDYWGQGTLVTVSSA

SEQ ID NO: 8654 - protein, 121 aa, Homo sapiens
  Heavy chain
QVQLVESGGGVVQPGRSLRLSCSASGFTFRGYGMHWVRQAPGKGLEWVAIIWNDGSNKYYADSVKGRFTISRDNSKNTLYLQMNSLRAEDTAVYYCARTYTWNDVGWDYWGQGTLVTVSSA

SEQ ID NO: 8655 - protein, 119 aa, Homo sapiens
  Heavy chain
EVQLVESGGGVVRPGGSLRLSCAASGFSFDDYGMSWVRQAPGKGLEWVSGINWNGGSTGYADSVKGRFTVSRDNAKKSLYLQMNSLRAEDTALYYCARDGWRLLDDYWGQGTLVTVSSA

SEQ ID NO: 8656 - protein, 121 aa, Homo sapiens; identical to SEQ ID NO: 8637
  Heavy chain

SEQ ID NO: 8657 - protein, 119 aa, Homo sapiens
  Heavy chain
QVQLVESGGGVVQPGRSLRLSCAASGFTFSSFGMHWVRQAPGKGLEWVAVIWYDGSNRFYADSVKGRFTLSRDNSKNTLFLQMNSLRAEDTAVYYCARGGHYGPFDYWGQGTLVTVSSA

SEQ ID NO: 8658 - protein, 121 aa, Homo sapiens; identical to SEQ ID NO: 8654
  Heavy chain

SEQ ID NO: 8659 - protein, 119 aa, Homo sapiens; identical to SEQ ID NO: 8648
  Heavy chain

SEQ ID NO: 8660 - protein, 129 aa, Homo sapiens
  Heavy chain
QVQLVESGGGVVQPGRSRRLSCAASGFMFSSYGMHWVRQAPGKGLEWVAVIWYDGTIKYYADSVQGRFTISRDNSKNTLYLQMNSLRAEDTAVYYCARKGDTSNGSGSHYNEGFFDIWGQGTMVTVSLA

SEQ ID NO: 8661 - protein, 119 aa, Homo sapiens; identical to SEQ ID NO: 8635
  Heavy chain

SEQ ID NO: 8662 - protein, 119 aa, Homo sapiens; identical to SEQ ID NO: 8627
  Heavy chain

SEQ ID NO: 8663 - protein, 119 aa, Homo sapiens; identical to SEQ ID NO: 8627
  Heavy chain

SEQ ID NO: 8664 - protein, 119 aa, Homo sapiens
  Heavy chain
EVQLVESGGGVVRPGGSLRLSCAASGFTFDDYGMSWVRQVPGKGLEWVSGINWNGGSTGYADSVKGRFTISRDNAKNSLYLQMNSLRAEDTALYYCVRDGWRLLDDYWGQGTLVTVSSA

SEQ ID NO: 8665 - protein, 118 aa, Homo sapiens; identical to SEQ ID NO: 8633
  Heavy chain

SEQ ID NO: 8666 - protein, 119 aa, Homo sapiens
  Heavy chain
EVQLVESGGGVVRPGGSLRLSCAASGFTFDDYGMSWVRQAPGKGLEWVSGINWNGGSTGYADSVKGRFTISRDNAKNSLYLQMNSLRAEDTALYHCARDGWELLDDYWGQGTLVTVSSA

SEQ ID NO: 8667 - protein, 119 aa, Homo sapiens; identical to SEQ ID NO: 8635
  Heavy chain

SEQ ID NO: 8668 - protein, 119 aa, Homo sapiens; identical to SEQ ID NO: 8635
  Heavy chain

SEQ ID NO: 8669 - protein, 118 aa, Homo sapiens
  Heavy chain
QVQLVQSGAEVKKPGASVKVSCKASGYTFTSYGISWVRQAPGQGLEWMGWISAYNGNTNYVQKFQGRVTMTTDTSTSTAYMELRSLRSDDTAVYFCARLSRAGHDYWGQGTLVTVSSA

SEQ ID NO: 8670 - protein, 115 aa, Homo sapiens
  Heavy chain
QVQLVESGGGVVQPGRSLRLSCAASGFTFSSYGIHWVRQAPGKGLEWVAVIWYDGRNKYYADSVKGRFTISRDNSKNTLYLQMNSLRAEDTAVYYCARGGNWGPFDYWGQGTLVT

SEQ ID NO: 8671 - protein, 119 aa, Homo sapiens; identical to SEQ ID NO: 8627
  Heavy chain

SEQ ID NO: 8672 - protein, 119 aa, Homo sapiens
  Heavy chain
EVQLVESGGRVVRPGGSLRLSCAVSGFTFADYGMSWVRQAPGKGLEWVSGINWNGGTTGYADSVKGRFTISRDNAKNSLYLQMNSLRAEDTALYHCVRDGWELLDDYWGRGTLVTVSSA

SEQ ID NO: 8673 - protein, 119 aa, Homo sapiens
  Heavy chain
QVQLVESGGGVVQPGRSLRLSCAASGFTLSSYGMHWVRQAPGKGLEWVAVIWYDGSNKHYADSVKGRFTISRDNSKNTLYLQMNSLRAEDTAVYYCVRGGIWGNFDYWGQGTLVTVSSA

SEQ ID NO: 8674 - protein, 119 aa, Homo sapiens
  Heavy chain
QVQLVESGGGVVQPGRSLRLSCAASGFTFSSYGMHWVRQAPGKGLEWVAVIWYDGSNKHYADSVKGRFTISRDNYKKTVSLQVNSLRAEDTAVYYCARGGIWGYFDSWGQGTLVTVSSA

SEQ ID NO: 8675 - protein, 115 aa, Homo sapiens
  Heavy chain
QVQLVESGGGVVQPGRSLRLSCAASGFTFSSYGIHWVRQAPGKGLEWVAVIWYDGRNKYYADSVKGRFTISRDNSKNTLYLQMNSLRAEDTAVYYCARAGNWGPFDSWGQGTLVT

SEQ ID NO: 8676 - protein, 119 aa, Homo sapiens
  Heavy chain
EVQLVESGGGVVRPGGSLRLSCAASGFTFDDYGMSWVRQTPGKGLEWVSGINWNGGSTGYVDSVKGRFIISRDNAKNSLYLQMNSLRAEDTALYYCARDGWKLLDDYWGQGTLVTVSSA

SEQ ID NO: 8677 - protein, 119 aa, Homo sapiens
  Heavy chain
EVQLVESGGGVVRPGGSLRLSCAASGFTFDDYGMSWVRQAPGKGLEWVSGINWNGGSTGYADSVKGRFTISRDNAKNSLYLQMNSLRAEDTALYHCVRDGWELLGDYWGQGTLVTVSSA

SEQ ID NO: 8678 - protein, 119 aa, Homo sapiens
  Heavy chain
QVQLVESGGGVVQPGRSLRLSCAASGFTFSNHGMHWVRQAPGKGLEWVAVIWYDGSNKHYADSVMGRFILSRDNSKNTLYLQMNSLRAEDTAVYYCARGGIWGYFDYWGQGTLVTVSSA

SEQ ID NO: 8679 - protein, 118 aa, Homo sapiens
  Heavy chain
QVQLVQSGPEVKKPGASVKVSCKASGYTFTSYGIGWVRQAPGQGLEWMGWISAYNGNTNYVQKFQGRVTMTTDTSTSTAYMELRSLRSDDTAVYYCARVGASGVDYWGQGTLVTVSSA

SEQ ID NO: 8680 - protein, 117 aa, Homo sapiens; identical to SEQ ID NO: 8651
  Heavy chain

SEQ ID NO: 8681 - protein, 124 aa, Homo sapiens
  Heavy chain
QVQLVQSGAEVKKPGASVKVSCKASGYTFTSYYMHWVRQAPGQGLEWMGIVNPSGGTSIYAQKFQGRVTMTRDTSTSTVYMELSGLISEDTAVYYCARDPPITLVRGAPFDYWGQGTLVTVSSA

SEQ ID NO: 8682 - protein, 124 aa, Homo sapiens
  Heavy chain
QVQLVQSGAEVKKPGASVKVSCKASGYTFTSYYMHWVRQAPGQGLEWMGIVNPSSGSTNYAQKFQGRVTMTSDTSTSTVYMGLNSLRSEDTAVYYCARDPPITMVRGAPFDYWGQGTLVTVSSA

SEQ ID NO: 8683 - protein, 118 aa, Homo sapiens
  Heavy chain
QVQLVQSGAEVKKPGASVKVSCKASGYTFTSYGISWVRQAPGQGLEWMGWISVYNGNTNYAQKLQGRVTMTTDTSTSTAYMELRSLRSDDTAVYYCARVGANWFDPWGQGSLVTVSSA

SEQ ID NO: 8684 - protein, 119 aa, Homo sapiens; identical to SEQ ID NO: 8635
  Heavy chain

SEQ ID NO: 8685 - protein, 119 aa, Homo sapiens
  Heavy chain
QVQLVESGGGVVQPGRSLRLSCAASGFTFSSYGMHWVRQALGKGLEWVAVIFYDGSNNYYADSVKGRFTISRDNSKNTLYLQMDSLRADDTAVYYCARGGFFGPFDYWGQGTLVTVSSA

SEQ ID NO: 8686 - protein, 119 aa, Homo sapiens; identical to SEQ ID NO: 8631
  Heavy chain

SEQ ID NO: 8687 - protein, 124 aa, Homo sapiens; identical to SEQ ID NO: 8682
  Heavy chain

SEQ ID NO: 8688 - protein, 119 aa, Homo sapiens
  Heavy chain
EVQLVESGGGVVRPGGSLRLSCAASGFTFDDYGMSWVRQAPGKGLEWVSGINWNGGNTGYVDSVKGRFIISRDNAKNSLYLQMNSLRVEDTALYYCARDGWRLLDDYWGQGTQVTVSSS

SEQ ID NO: 8689 - protein, 122 aa, Homo sapiens
  Heavy chain
QVQLVQSGAEVKKPGASVKVSCKASGYTFTSYGINWVRQAPGQGLEWMGWISAYNGNTNYAQKLQGRVTMTTDTSTSTAYMELRSLRSDDTAVYYCARLYCSGGSCYSDYWGQGTLVTVSSA

SEQ ID NO: 8690 - protein, 124 aa, Homo sapiens
  Heavy chain
QVQLVQSGAEVKKPGASVKVSCKASGFTFTSYYIHWVRQAPGQGLEWMGIINPSGGSTISAQKFQGRVTMTSDTSTSTVSMELSSLRSDDTAVYYCARDPPITMVRDAPFDYWGQGTLVTVSSA

SEQ ID NO: 8691 - protein, 121 aa, Homo sapiens; identical to SEQ ID NO: 8652
  Heavy chain

SEQ ID NO: 8692 - protein, 129 aa, Homo sapiens
  Heavy chain
QVQLVESGGGVVQPGRSLRLSCAASGFTFSSYGMHWVRQAPGKGLEWVAVIWYDGNHKYYADSVQGRFTISRDNSKNTLYLQMNSLGAEDTAVYYCARKGDNSYGSGSYYNEGFFDMWGQGTMVTVSSA

SEQ ID NO: 8693 - protein, 119 aa, Homo sapiens
  Heavy chain
QVQLVESGGGVVQPGRSLRLSCAASGFTFSSYGMHWVRQAPGKGLEWVAVIWYDGRNKFYADSVKGRFTISRDNSKNTLYLQMNSLRAEDTAVYYCARVGLLGGMDVWGQGTTVTVSSA

SEQ ID NO: 8694 - protein, 119 aa, Homo sapiens; identical to SEQ ID NO: 8677
  Heavy chain

SEQ ID NO: 8695 - protein, 119 aa, Homo sapiens; identical to SEQ ID NO: 8631
  Heavy chain

SEQ ID NO: 8696 - protein, 129 aa, Homo sapiens
  Heavy chain
QVQLVESGGGVVQPGRSRRLSCAASGFMFSSYGMHWVRQAPGKGLEWVAVIWYDGTIKYYADSVQGRFTISRDNSKNTLYLQMNSLRAEDTAMYYCARKGDTSNGSGSHYNEGFFDIWGQGTMVTVSLA

SEQ ID NO: 8697 - protein, 119 aa, Homo sapiens
  Heavy chain
QVQLVESGGGVVQPGRSLRLSCAASGFTLSSHGMHWVRQAPGKGLEWVAVTWYDGSNKHYADSVKGRFTISRDNSKNTLYLQMNSLRVEDTAVYYCARGGLLGATDYWGQGTLVTVSSA

SEQ ID NO: 8698 - protein, 119 aa, Homo sapiens; identical to SEQ ID NO: 8688
  Heavy chain

SEQ ID NO: 8699 - protein, 119 aa, Homo sapiens
  Heavy chain
QVQLVESGGGVVQPGRSLRLSCAASGFTFSSHGMDWVRQAPGKGLEWVAVIWYDGRNKYYADSVKGRFTISRDNSKNTLYLQMNSLRVEDTAVYYCARGGLIGGFDFWGQGTLVTVSSA

SEQ ID NO: 8700 - protein, 124 aa, Homo sapiens
  Heavy chain
QVQLVQSGAEVQKPGASVKVSCKASGYTFTSYYMHWVRQAPGQGLEWMGIINPSGGSSNYAQKFLDRLTMTRDTSTSTVYMELSGLRSEDTAVYYCARDPPITMFRGAPFDYWGQGTLVTVSSA

SEQ ID NO: 8701 - protein, 119 aa, Homo sapiens
  Heavy chain
QVQLVESGGGVVQPGRSLRLSCAASGFTFSSYGIHWVRQAPGKGLEWVAVIWYDGRNKYYADSVKGRFTMSRDNSKNTLYLQMNSLRAEDTAVYFCARVGLLGAMDVWGQGTTVTVSSA

SEQ ID NO: 8702 - protein, 119 aa, Homo sapiens
  Heavy chain
QVQLVESGGGVVQPGRSLRLSCAASGFTFSSHGMDWVRQAPGKGLEWVAVIWYDGRNKYYADSVKGRFTISRDNSKNTLYLQMNSLRVEDTAVYYCARGGLIGGFDHWGQGTLVTVSSA

SEQ ID NO: 8703 - protein, 119 aa, Homo sapiens
  Heavy chain
QVQLVESGGGVVQPGRSLRLSCAASGFTFSSYGMHWVRQAPGKGLEWVAVIWYDGNNKHYADAVRGRFTISRDNSKNTLYLQMNSLRAEDTAVYHCVRGGIWGYFDYWGQGTLVTVSSA

SEQ ID NO: 8704 - protein, 121 aa, Homo sapiens
  Heavy chain
QVQLVQSGAEVKKPGASVKVSCKASGYTFTNYGISWVRQAPGQGLEWMGWISAYNGNTNYAQKLQGRVTMTTDTSTSTAYMELRSLRSDDTAVYYCARKNGYDPNGFDPWGQGTLVTVSSA

SEQ ID NO: 8705 - protein, 119 aa, Homo sapiens; identical to SEQ ID NO: 8631
  Heavy chain

SEQ ID NO: 8706 - protein, 118 aa, Homo sapiens; identical to SEQ ID NO: 8683
  Heavy chain

SEQ ID NO: 8707 - protein, 119 aa, Homo sapiens; identical to SEQ ID NO: 8685
  Heavy chain

SEQ ID NO: 8708 - protein, 119 aa, Homo sapiens
  Heavy chain
QVQLVESGGGVVQPGRSLRLSCAASGFIFSSYGMHWVRQAPGKGLEWVAVIWYDGRNKHYADSVKGRFTISRDNSKNTLYLQMNSLRAEDTAVYYCARSGSLGAFDIWGQGTMVTVSSA

SEQ ID NO: 8709 - protein, 119 aa, Homo sapiens
  Heavy chain
EVQLVESGGGVVRPGGSLRLSCAASGFIFEDYGMSWVRQTPGKGVEWVSGINWNGGNTGYADSVKGRFTISRDNAKSFLYLQMNGLRAEDTALYYCARDGWKLLDDYWGQGTLVTVSSA

SEQ ID NO: 8710 - protein, 119 aa, Homo sapiens
  Heavy chain
EVQLVESGGGVVRPGGSLRLSCAASGFTFDDYGMSWVRQAPGKGLEWVSGINWNGGSTGYVDSVKGRFIISRDNAKNSLYLQMNSLRAEDTALYYCARDGWRLLDDYWGQGTLVTVSSA

SEQ ID NO: 8711 - protein, 124 aa, Homo sapiens
  Heavy chain
QVQLVQSGAEVKKPGASVKVSCKSSGYTFTSYYMHWVRQAPGQGLEWMGIINPSSGGSTYAQKFQGRVTMTRDTSTSTVYMELSVLRSEDTAVYYCARDPPITMVRGAPFDYWGQGTLVTVSSA

SEQ ID NO: 8712 - protein, 119 aa, Homo sapiens
  Heavy chain
QVQLVESGGGVVQPGRSLRLSCAASGFTFSSYGMHWVRQAPGKGLEWVAVIWYDGNNKHYAVSVKGRFTISRDISTNTLYLQMNSLRAEDTAVYYCARGGLLGGFDYWGQGTLVTVSSA

SEQ ID NO: 8713 - protein, 121 aa, Homo sapiens; identical to SEQ ID NO: 8637
  Heavy chain

SEQ ID NO: 8714 - protein, 119 aa, Homo sapiens
  Heavy chain
QVQLVESGGGVVQPGRSLRLSCAASGFTFSNFGIHWVRQAPGKGLEWVAVIWYDGRNKHYADSVEGRFTITRDNSNNTLYLQMNSLRAEDTAVYYCARQGYMGSLDYWGQGILVTVSSA

SEQ ID NO: 8715 - protein, 118 aa, Homo sapiens
  Heavy chain
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARVGANWFDPWGQGTLVTVSSA

SEQ ID NO: 8716 - protein, 119 aa, Homo sapiens; identical to SEQ ID NO: 8712
  Heavy chain

SEQ ID NO: 8717 - protein, 119 aa, Homo sapiens
  Heavy chain
EVQLVESGGGVVRPGGSLRLSCAASGFTFDDYGMSWVRQAPGKGLEWVSGINWNGGSTGYVDSVKGRFAISRDNAKNSLYLQMNSLRAEDTALYHCVRDGWELLGDYWGQGTLVTVSSA

SEQ ID NO: 8718 - protein, 119 aa, Homo sapiens
  Heavy chain
EVQLVESEGGVVRPGGSLRLSCAASGFTFDDYGMSWVRQAPGKGLEWVSGINWNGGSTGYADSVKGRFTISRDNAKNSLYLQMNSLRAEDTALYHCARDGWELLDDYWGRGTLVTVSSA

SEQ ID NO: 8719 - protein, 119 aa, Homo sapiens; identical to SEQ ID NO: 8709
  Heavy chain

SEQ ID NO: 8720 - protein, 119 aa, Homo sapiens
  Heavy chain
EVQLVESGGGVVRPGGSLRLSCAASGFTFDDYGMSWVRQAPGKGLEWVSGINWNGGSTGYADSVKGRFTISRDNAKNSLYLQMNSLRAEDTALYHCMRDGWELLGDFWGQGTLVTVSSA

SEQ ID NO: 8721 - protein, 118 aa, Homo sapiens
  Heavy chain
QVQLVQSGAEVKKPGASVKVSCKASGYTFTSYGVTWVRQAPGQGLECMGWISAYNGNTNYAQKLQGRVTMTTDTSTNTAYMELRSLRSDDTAVYYCARKSPWGFDYWGQGTLVTVSSA

SEQ ID NO: 8722 - protein, 119 aa, Homo sapiens; identical to SEQ ID NO: 8709
  Heavy chain

SEQ ID NO: 8723 - protein, 119 aa, Homo sapiens; identical to SEQ ID NO: 8709
  Heavy chain

SEQ ID NO: 8724 - protein, 119 aa, Homo sapiens
  Heavy chain
EVQLVESGGGVVRPGGSLRLSCAASGFIFEDYGMSWVRQTPGKGVEWVSGINWNGGNTGYADSVKGRFTISRDNAKSFLYLQMNGLRAEDTALYYCARDGWKRLDDYWGQGTLVTVSSA

SEQ ID NO: 8725 - protein, 119 aa, Homo sapiens
  Heavy chain
EVQLVESGGGVVRPGGSLRLSCAASGFTFDDYGMSWVRQAPGKGLEWVSGINWNGASTGYVDSVKGRFIISRDNAKNSLYLQMNSLRVEDTALYYCARDGWKLLDDSWGQGTLVTVSSA

SEQ ID NO: 8726 - protein, 119 aa, Homo sapiens; identical to SEQ ID NO: 8709
  Heavy chain

SEQ ID NO: 8727 - protein, 121 aa, Homo sapiens
  Heavy chain
QVQLVESGGGVVQPGGSLRLSCAASGFTLRGYGMHWVRQAPGKGLEWVAVIWNDGSNKYYADSVKGRFTISRDNSKNTLYLQMNSLRAEDTAVYYCARTYTWNDVGWDYWGQGTLVTVSSA

SEQ ID NO: 8728 - protein, 119 aa, Homo sapiens
  Heavy chain
EVQLVESGGGVVRPGGSLRLSCAASGFIFEDYGMSWVRQTPGKGVEWVSGINWNGGNTGYADSVKGRFTISRDNAKSFLYLQMNGLRAEDTALYYCARDGWNLLDDYWGQGTLVTVSSA

SEQ ID NO: 8729 - protein, 118 aa, Homo sapiens
  Heavy chain
QVQLVQSGTDVKKPGASVKVSCKASGYTFTSYGITWVRQAPGQGLECMGWISVYNGNTNYAQKLQDRVTMTTDTSTSTAYMELRSLRSDDTAVYYCARKNRWGFDYWGQGTQVTVSSA

SEQ ID NO: 8730 - protein, 115 aa, Homo sapiens
  Heavy chain
EVQLVESGGGVVRPGGSLRLSCAASGFTFDDYGMSWVRQAPGKGLEWVSGINWNGGSTGYADSVKGRFTISRDNAKNSLYLQMNSLRAEDTALYHCARDGWKLRDDYWGQGTLVT

SEQ ID NO: 8731 - protein, 129 aa, Homo sapiens
  Heavy chain
QVQLVESGGGVVQPGNSLRVSCAASGFIFSSYGMHWVRQAPGKGLEWVAVIWYDGGIKYYADSVKGRFTISRDNSKNTLYLQMTSLRAEDTAVYYCARKGDNSYGSGSHYNEGFFDIWGQGTMVTVSSA

SEQ ID NO: 8732 - protein, 120 aa, Homo sapiens
  Heavy chain
QVQLVQSGAEVKKPGASVKVSCKASGYTFTNYGISWVRQAPGQGLEWMGWISAYNGNTNFAQKFQGRVTMTTDTSTSTAYMELRSLRSDDTAVYYCARGPSGPYEGDYWGQGTLVTVSSA

SEQ ID NO: 8733 - protein, 119 aa, Homo sapiens
  Heavy chain
EVQLVESGGGVVRPGGSLRLSCAASGFIFEDYGMSWVRQTPGKGVEWVSGINWNGGNTGYADSVKGRFTISRDNAKSFLYLQMNGLRAEDTALYYCVRDGWKLLDDYWGQGTLVTVSSA

SEQ ID NO: 8734 - protein, 118 aa, Homo sapiens
  Heavy chain
QVQLVQSGAEVKKPGASVKVSCKASGYTFTSYGISWVRQAPGQGLEWMGWISAYNGNTNYAQKLQGRVTMTTDTSTNTAYMELRSLRSDDTAVYYCARVGANWFDPWGQGTLVTVSSA

SEQ ID NO: 8735 - protein, 119 aa, Homo sapiens
  Heavy chain
QVQLVESGGGVVQPGRSLRLSCAASGFTFSSHGMHWVRQAPGKGLEWVAVTWYDGSNKHYADSVKGRATISRDNSKNTLYLQMNSLRAEDTAVYYCTRGELLGYFDYWGQGTLVTVSSA

SEQ ID NO: 8736 - protein, 119 aa, Homo sapiens
  Heavy chain
QVQLVQSGAEVKKPGASVKVSCKASGYTFNSYGISWVRQAPGQGLEWMGWISAYNGNTNYAQKLQGRVTMTTDTSTSTAYMELRSLRSDDTAVYFCARVGRHLAFAYWGQGTLVTVSSA

SEQ ID NO: 8737 - protein, 119 aa, Homo sapiens
  Heavy chain
QVQLVESGGGVVQPGRSLRVSCAASGFIFSSYGIHWVRQAPGKGLEWVAVIWYDGSNKHYADSVKGRFTISRDNSKNTLYLQMNSLRADDTAVYYCARGHLLGYFDYWGQGTLVTVSSA

SEQ ID NO: 8738 - protein, 119 aa, Homo sapiens
  Heavy chain
QVQLVESGGGVVQPGRSLRLSCAASGFTFSSYGVHWVRQAPGKGLEWVSVILYDGNNKFYADSVKGRFTISRDNSKNTLYLQMNSLRAEDTAVYFCARGALLGAFDIWGRGTMVTVSSA

SEQ ID NO: 8739 - protein, 119 aa, Homo sapiens
  Heavy chain
QVQLVESGGGVVQPGRSLRLSCAASGFTFSSHGMHWVRQAPGKGLEWVAVIWYDGSNKHYADSVKGRFTISRDNSKNTLYLQMNSLRAEGTAVYYCARGGLMGGFDYWGQGTLVTVSSA

SEQ ID NO: 8740 - protein, 119 aa, Homo sapiens
  Heavy chain
QVQLVESGGGVVQPGRSLRLSCAASGFTFSSHGIHWVRQAPGKGLEWVAVIWYDGSNKHYGDSVKGRFTISRDNSKNTLYLQMNSLRAEDTAVYYCARGGYFGCFDHWGQGTLVTVSSA

SEQ ID NO: 8741 - protein, 122 aa, Homo sapiens
  Heavy chain
QVQLVESGGDVVQPGRSLRLSCAASGFTFSSHAMHWVRQAPGKGLEWVAVIWYDGNNKYYEDSVKGRFTISRDNSKNTLYLQMNSLRAEDTAVYYCAREKGIGWYEGMDVWGQGTTVTVSSA

SEQ ID NO: 8742 - protein, 119 aa, Homo sapiens
  Heavy chain
QVQLVESGGGVVQPGRSLRLSCAASGFTFSSYGMHWVRQAPGKGLEWVAAIWYDGNNKYYIDSVKGRFTISRDSSKNTLFLQMNSLRAEDTAVYYCARGGQLGYFDYWGQGTLVTVSSA

SEQ ID NO: 8743 - protein, 120 aa, Homo sapiens
  Heavy chain
QVQLQESGPGLVKPSETLSLTCTVSGGSISSYYWSWIRQPPGKGLEWIGYIHYSGRTNYNPSLKSRVTITVDTSEKQFSLKVNSVTAADTAVYYCARGYRGSYGLFDYWGQGILVTVSSA

SEQ ID NO: 8744 - protein, 122 aa, Homo sapiens
  Heavy chain
QVQLVESGGDVVQPGRSLRISCAASGFTFSSHAMHWVRQAPGKGLEWVAVIWYDGNNKYYEDSVNGRFTISRDNSKNTLYLQMNSLRAEDTALYFCAKEKGIGWYEGMDVWGQGTTVTVSSA

SEQ ID NO: 8745 - protein, 119 aa, Homo sapiens
  Heavy chain
QVQLVQSGAEVKKPGASVKVSCKASGYTFTSYGISWVRQAPGQGLECMGWISAYNGNTNYAQKLQGRVTMTTDTSTSTAYMELRSLRSDDTAVYYCARVGRFGEFDYWGQGTLVTVSSA

SEQ ID NO: 8746 - protein, 119 aa, Homo sapiens
  Heavy chain
QVQLVESGGGVVQPGRSLRLSCAASGFTFSSHGMHWVRQAPGKGLEWVAVIWYDGSNKHYADSVKGRFTTSRDNSKNTLHLQMNSLRAEDTAVYYCTRGGYFGCFDYWGQGTLVTVSSA

SEQ ID NO: 8747 - protein, 119 aa, Homo sapiens
  Heavy chain
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARGGYLGAFDIWGQGTMVTVSSA

SEQ ID NO: 8748 - protein, 119 aa, Homo sapiens
  Heavy chain
QVQLVESGGGVVQPGRSLRLSCAASGFTFSTHGMHWVRQAPGKGLEWVAVVWYDGSNKHYADSVKGRFTISRDNSKNTLYLQMNSLRVEDTAVYYCARGGYFGCFDYWGQGTLVTVSSA

SEQ ID NO: 8749 - protein, 119 aa, Homo sapiens; identical to SEQ ID NO: 8748
  Heavy chain

SEQ ID NO: 8750 - protein, 119 aa, Homo sapiens
  Heavy chain
QVQLVESGGGVVQPGRSLRLSCAASGFTFSSYGMHWVRQAPGKGLEWVAVIWYDGSNRYYADSVKGRFTISRDISKNTLYLQMNSLRAEDTAMYYCARGDLLGAFDIWGQGTMVTVSSA

SEQ ID NO: 8751 - protein, 119 aa, Homo sapiens; identical to SEQ ID NO: 8748
  Heavy chain

SEQ ID NO: 8752 - protein, 121 aa, Homo sapiens
  Heavy chain
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARLTGTTSHAFDIWGQGTMVTVSSA

SEQ ID NO: 8753 - protein, 117 aa, Homo sapiens
  Heavy chain
QVQLVQSGAEVKKPGASVKVSCKASGYTFTSYGITWVRQAPGQGLEWMGWISAYNGNTHYAQKFQGRVTMTTDTSTTTAYMELRSLRSDDTAVYYCARVGPSFDYWGQGALVTVSSA

SEQ ID NO: 8754 - protein, 118 aa, Homo sapiens
  Heavy chain
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARVGVNWFDPWGQGTLVTVSSA

SEQ ID NO: 8755 - protein, 121 aa, Homo sapiens
  Heavy chain
QVQLVQSGAEVKKPGASVKVSCKASGYTFTSYGISWVRQAPGQGLEWMGWISAYNGNTNYAQNLQGRVTMTTDTSTSTAYMELRSLRSDDTAVFYCARLTGATSHAFDIWGQGTMVTVSSA

SEQ ID NO: 8756 - protein, 118 aa, Homo sapiens
  Heavy chain
QVQLVQSGAEVKKPGASVKVSCKASGYTFTSYGISWVRQAPGQGLEWMGWISAYNGNTNYAQKLQGRVTMTTDTSTNTAYMELRSLRSDDTAVYYCVRVGANWFDPWGQGTLVTVSSA

SEQ ID NO: 8757 - protein, 119 aa, Homo sapiens
  Heavy chain
QVQLVESGGGVVQPGRSLRLSCAASGFTFSSYGMHWVRQAPGKGLEWVAVIWYDGRNKYYADSVKGRFTISRDNSKNTLDLQMNSLRAEDTAVYYCARNQPLGSFDYWGQGTLVTVSSA

SEQ ID NO: 8758 - protein, 119 aa, Homo sapiens
  Heavy chain
QVQLVESGGGVVQPGRSLRLSCAASGFTFSSYGIHWVRQAPGKGLEWVAVIWYDGSNKHYADSVKGRSTISRDNSKNTLYLQMNSLRAEDTAVYYCARGELLGYFDYWGQGTLVTVSSA

SEQ ID NO: 8759 - protein, 119 aa, Homo sapiens; identical to SEQ ID NO: 8740
  Heavy chain

SEQ ID NO: 8760 - protein, 118 aa, Homo sapiens; identical to SEQ ID NO: 8734
  Heavy chain

SEQ ID NO: 8761 - protein, 119 aa, Homo sapiens
  Heavy chain
QVQLVQSGAEVKKPGASVKVSCKASGYTFTNYGISWVRQAPGQGLEWMGWISAYNGNTNYAQKLQGRVTMTTDTSTSTAYMELRSLRSDDTAVYYCARVAGYDAFDIWGQGTMVTVSSA

SEQ ID NO: 8762 - protein, 118 aa, Homo sapiens; identical to SEQ ID NO: 8734
  Heavy chain

SEQ ID NO: 8763 - protein, 118 aa, Homo sapiens; identical to SEQ ID NO: 8734
  Heavy chain

SEQ ID NO: 8764 - protein, 119 aa, Homo sapiens; identical to SEQ ID NO: 8738
  Heavy chain

SEQ ID NO: 8765 - protein, 118 aa, Homo sapiens; identical to SEQ ID NO: 8734
  Heavy chain

SEQ ID NO: 8766 - protein, 119 aa, Homo sapiens; identical to SEQ ID NO: 8748
  Heavy chain

SEQ ID NO: 8767 - protein, 119 aa, Homo sapiens; identical to SEQ ID NO: 8735
  Heavy chain

SEQ ID NO: 8768 - protein, 125 aa, Homo sapiens
  Heavy chain
QVQLVQSGAEVKKPGASVKVSCKASGYTFTSYGINWVRQAPGQGLEWMGWISAYNGNTNYAQKLQGRVTMTTDTSTSTAYMELRSLRSDDTAVYYCARDPVTMVRGVHWYFDLWGRGTLVTVSSA

SEQ ID NO: 8769 - protein, 119 aa, Homo sapiens; identical to SEQ ID NO: 8735
  Heavy chain

SEQ ID NO: 8770 - protein, 119 aa, Homo sapiens; identical to SEQ ID NO: 8736
  Heavy chain

SEQ ID NO: 8771 - protein, 119 aa, Homo sapiens
  Heavy chain
QVQLVESGGGVVQPGRSLRLSCAASGFTFSSYGLHWVRQAPGKGLEWVAVIWYDGSNKHYADSVKGRFTISRDNAKNTLYLQMNSLRAEDTAVYYCARGALLGAFEIWGQGTMVTVSSA

SEQ ID NO: 8772 - protein, 119 aa, Homo sapiens
  Heavy chain
QVQLVESGGGVVQPGRSLRLSCAASGFTFSSYGIHWVRQAPGKGLEWVAVIWYDGSNKHYADSVKGRFTISRDNSKNTLYLQMNSLRAEDTAVYYCARGELLGYFDYWGQGTLVTVSSA

SEQ ID NO: 8773 - protein, 119 aa, Homo sapiens
  Heavy chain
QVQLVESGGGVVQPGRSLRLSCAASGFTFSSHGMHWVRQAPGKGLEWVAVIWYDGSNKHYADSVKGRFTTSRDNSKNTLHLQMNSLRAEDTAVYYCARGGYFGCFDYWGQGTLVTVSSA

SEQ ID NO: 8774 - protein, 119 aa, Homo sapiens; identical to SEQ ID NO: 8773
  Heavy chain

SEQ ID NO: 8775 - protein, 119 aa, Homo sapiens
  Heavy chain
QVQLVESGGGVVQPGRSLRLSCAASGFTFSSYGMHWVRQAPGKGLEWVAVIWYDGNNKYYADSVKGRFTFSRDNSKNTLYLQMNSLRAEDTAVYYCARGALLGGFDYWGQGTLVTVSSA

SEQ ID NO: 8776 - protein, 119 aa, Homo sapiens
  Heavy chain
QVQLVESGGGVVQPGRSLRLSCEASGFTFSSYGMHWVRQAPGKGLEWVAVIWYEGRNKHYADSVKGRFTISRDNSKNTLYMQMNSLRAEDTAVYYCARGGELGPFDYWGQGTLVTVSSA

SEQ ID NO: 8777 - protein, 119 aa, Homo sapiens
  Heavy chain
QVQLVESGGGVVQPGRSLRLSCAASGFTFSSYGTHWVRQAPGKGLEWVAVIWYDGSNKYYADSVKGRFTISRDNSKNTLYLQMNSLRAEDTAVYYCARAGNWGAFDIWGQGTMVTVSSA

SEQ ID NO: 8778 - protein, 119 aa, Homo sapiens
  Heavy chain
QVQLVESGGGVVQPGRSLRLSCAASGFTFRSYGMHWVRQAPGKGLEWVAVTWYDGSNKNYADSVKGRFTISRDNSKNTLYLQMNSLRAEDTAVYYCARGGLTGDFDYWGQGTLVTVSSA

SEQ ID NO: 8779 - protein, 119 aa, Homo sapiens
  Heavy chain
QVQLVESGGGVVQPGRSLRLSCAASGFTFSSYGMHWVRQAPGKGLEWVAVTWYDGRNKYYADSLKGRFTISRDISKNTLYLQMNSLRDEDTAVYYCARGGSYGAFDIWGQGTMVTVSSA

SEQ ID NO: 8780 - protein, 119 aa, Homo sapiens
  Heavy chain
QVQLVESGGGVVQPGRSLRLSCAASGFTFSSYGIHWVRQAPGKGLEWVAVIWYDGSNKHYADSVKGRFTISRDNSKNTLYLQMNSLRAEDTAVYYCARGELLGYFDNWGQGTLVTVSSA

SEQ ID NO: 8781 - protein, 119 aa, Homo sapiens
  Heavy chain
QVQLVESGGGVVQPGRSLRLSCAASGFAFSSYGIHWVRQAPGKGLEWVAVIWYDGSNKHYADSVKGRSTISRDNSKNTLYLQMNSLRAEDTAVYYCARGELLGYFDSWGQGTLVTVSSA

SEQ ID NO: 8782 - protein, 119 aa, Homo sapiens
  Heavy chain
QVQLVESGGGVVQPGRSLRLSCAASGFTFSSYGIHWVRQAPGKGLEWVAVTWYDGSNKYYADSVKGRFTISRDNSKNTLFLQMNSLRAEDTAVYYCARGGLLGHFDYWGQGTLVTVSSA

SEQ ID NO: 8783 - protein, 119 aa, Homo sapiens; identical to SEQ ID NO: 8772
  Heavy chain

SEQ ID NO: 8784 - protein, 119 aa, Homo sapiens; identical to SEQ ID NO: 8782
  Heavy chain

SEQ ID NO: 8785 - protein, 119 aa, Homo sapiens
  Heavy chain
QVQLVESGGGVVQPERSLRLSCAASGFTFSSYGMHWVRQAPGKGLEWVAVIWYDGSNKHYADSVKGRFTISRDNSKNTLYLQMNSLRAEDTAVYYCARGGRLGAFDYWGQGTLVTVSSA

SEQ ID NO: 8786 - protein, 119 aa, Homo sapiens
  Heavy chain
QVQLVESGGGVVQPGRSLRLSCAASGFTFSSYGMHWVRQAPGKGLEWVAVIWYDGNNKHYADSVKGRSTISRDNSKNTLYLQMNSLRAEDTAVYYCARGGLLGYFDYWGQGTLVTVSSA

SEQ ID NO: 8787 - protein, 119 aa, Homo sapiens
  Heavy chain
QVQLVESGGGVVQPGRSLRLSCAASGFTFSSYGMHWVRQAPGKGLEWVAVVWYDGNNKHYADSVKGRFTISRDNSKNTLYLQMNSLRAEDTAVYYCARGDLLGSFDYWGQGTLVTVSSA

SEQ ID NO: 8788 - protein, 119 aa, Homo sapiens; identical to SEQ ID NO: 8772
  Heavy chain

SEQ ID NO: 8789 - protein, 119 aa, Homo sapiens
  Heavy chain
QVQLVESGGGVVQPGRSLRLSCAASGFTFSSYGIHWVRQAPGKGLEWVAVTWYDGSNKNYADSVKGRFTISRDNSKNKLYLQMNSLRAEDTAVYYCVRGELLGYFDYWGQGTLVTVSSA

SEQ ID NO: 8790 - protein, 121 aa, Homo sapiens
  Heavy chain
QVQLVESGGGVVQPGRSLRLSCAASGFTFSSYGMHWVRQAPGKGLEWVAVIWYDGSNKYYADSVKGRFTISRDDSRYTLYLQMNSLRAEDTAVYYCARGSILAAGIFDYWGQGTLVTVSSA

SEQ ID NO: 8791 - protein, 119 aa, Homo sapiens
  Heavy chain
QVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGDWGAFDIWGQGTMVTVSSA

SEQ ID NO: 8792 - protein, 118 aa, Homo sapiens
  Heavy chain
QVQLVESGGGVVQPGRSLRLSCAASGFTFSSYGMHWVRQAPGKGLEWVAVKWYDGSNKHYVDSVKGRFTISRDNSKNTLYLQMNSLRAEDTAVYYCARSIVGAFDFWGQGTLVTVSSA

SEQ ID NO: 8793 - protein, 119 aa, Homo sapiens
  Heavy chain
QVQLVESGGGVVQPGRSLRLSCAASGFTFSSYGMHWVRQAPGKGLEWVAVIWYDGSNKNYADSVKGRFTISRDKSKNTLYLQMNSLRAEDTAVYYCARGGLTGGFDYWGQGTLVTVSSA

SEQ ID NO: 8794 - protein, 119 aa, Homo sapiens
  Heavy chain
QVQLVESGGGVVQPGRSLRLSCAASGFTFSSYGMNWVRQAPGKGLEWVAVTWYDGNNKHYADSVKGRFTISRDNSKNTLYLQMNSLKAEDTAVYYCARGGFFGCFDYWGQGALVTVSSA

SEQ ID NO: 8795 - protein, 119 aa, Homo sapiens; identical to SEQ ID NO: 8747
  Heavy chain

SEQ ID NO: 8796 - protein, 119 aa, Homo sapiens
  Heavy chain
QVQLVESGGGVVQPGRSLRLSCAASGFTFSSYGMHWVRQAPGKGLEWVAVIWYDGSNKHYADSLKGRFTISRDNSKNTLYLQMNSLRAEDTAVYYCARGSKLGPFDYWGQGTLVTVSSA

SEQ ID NO: 8797 - protein, 119 aa, Homo sapiens
  Heavy chain
QVQLVESGGGVVQPGRSLRLSCAASGFTFSSFGMHWVRQAPGKGLEWVAVTWYNGRNKYYADSVKGRFTISRDISKSTLYLQMNSLRVEDTAIYYCARGGYYGAFDIWGQGTMVTVSSA

SEQ ID NO: 8798 - protein, 119 aa, Homo sapiens; identical to SEQ ID NO: 8787
  Heavy chain

SEQ ID NO: 8799 - protein, 119 aa, Homo sapiens
  Heavy chain
QVQLVESGGGVVQPGRSLRLSCAASGFTFSSYGMHWVRQAPGKGLEWVAVVWYDGNNKHYADSVKGRFTISRDNSKNTLYLQMNSLRAEDTAVFYCARGHLLGSFDYWGQGTLVTVSSA

SEQ ID NO: 8800 - protein, 120 aa, Homo sapiens
  Heavy chain
QVQLQESGPGLVKPSETLSLTCTVSGGSISSYYWSWIRQPPGKGLEWIGYIHYSGRTNYNPSLKSRVTISVDTSKNQFSLKLSSVTAADTAVYYCARGYRGSYGLFDYWGQGTLVPVSSA

SEQ ID NO: 8801 - protein, 119 aa, Homo sapiens; identical to SEQ ID NO: 8737
  Heavy chain

SEQ ID NO: 8802 - protein, 125 aa, Homo sapiens
  Heavy chain
EVQLVESGGGLVQPGGSLRLSCAASGFTFSIYTMSWVRQAPGKGLEWVSTISGSGGGTYYADSVKGRFTISRDNSKNTLYLQMNSLRAEDTAVYYCAKDLLRYFDWLLSPFDYWGQGTLVTVSSA

SEQ ID NO: 8803 - protein, 119 aa, Homo sapiens; identical to SEQ ID NO: 8797
  Heavy chain

SEQ ID NO: 8804 - protein, 125 aa, Homo sapiens
  Heavy chain
QVQLVESGGGVVQPGRSLRLSCAASGFTFSSYGMHWVRQAPGKGLEWVAVISYDGSKKYYADSVKGRFTISRDNSKNTLYLQMNSLRAEDTAVYYCAREDDILTAYYYYGMDVWGQGTTVTVSSA

SEQ ID NO: 8805 - protein, 119 aa, Homo sapiens
  Heavy chain
QVQLVESGGGVVQPGRSLRLSCAASGFTFSSHGMHWVRQAPGKGLEWVAVTWYDGRNKYYADSVKGRLTISRDNSKNTLYLEMNSLRAEDTAVYYCARGGYYGPFDIWGQGTMVTVSSA

SEQ ID NO: 8806 - protein, 119 aa, Homo sapiens; identical to SEQ ID NO: 8739
  Heavy chain

SEQ ID NO: 8807 - protein, 118 aa, Homo sapiens
  Heavy chain
QVQLVESGGGVVQPGRSLRLSCAASGFTFSSYGMHWVRQAPGKGLEWVAVTWYDGSNKYYADSVKGRFTSSRDNSKNTLYLQMNSLRAEDTAVYYCARSIVGAFDYWGQGTLVTVSSA

SEQ ID NO: 8808 - protein, 120 aa, Homo sapiens
  Heavy chain
QVQLQESGPGLVKPSETLSLTCTVSGGSISSYYWSWIRQPPGKGLEWIGYIYYSGRTNYNPSLKSRVTISVDTSKNQLSLKLSSVTAADTAVYYCARGYSGSYGLFDYWGQGTLVTVSSA

SEQ ID NO: 8809 - protein, 119 aa, Homo sapiens; identical to SEQ ID NO: 8740
  Heavy chain

SEQ ID NO: 8810 - protein, 119 aa, Homo sapiens; identical to SEQ ID NO: 8757
  Heavy chain

SEQ ID NO: 8811 - protein, 125 aa, Homo sapiens
  Heavy chain
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCARDRGTYYDYYYYGMDVWGQGTTVTVSSA

SEQ ID NO: 8812 - protein, 123 aa, Homo sapiens
  Heavy chain
QVQLVESGGGVVQPGRSLRLSCAASGFTFSNYGMHWVRQAPGKGLEWVSVISYDGSHKYYADSVKGRFTISRDSSKNTLYLQMNSLRAEDTAVYYCARDDDILTGLYGMDVWGQGTTVTVSSA

SEQ ID NO: 8813 - protein, 125 aa, Homo sapiens; identical to SEQ ID NO: 8811
  Heavy chain

SEQ ID NO: 8814 - protein, 126 aa, Homo sapiens
  Heavy chain
EVQLVESGGGLVQPGGSLRLSCAASGFTFSSYWMSWVRQAPGKGLEWVANIKQDGSEKYYVDSVKGRFTISRDNAKNSLYLQMNSLRAEDTAVYYCARDRYYYGSGRYYRYLDLWGRGTLVTVSSA

SEQ ID NO: 8815 - protein, 122 aa, Homo sapiens
  Heavy chain
QVQLVESGGGVVQPGRSLRLSCAASGFTFSSYAMHWVRQAPGKGLEWVAVIWYDGNNKYYADSVKGRFTISRDNSKNTLYLQMNSLRAEDTAVYYCARDRGSGNYEYFDLWGRGTLVTVSSA

SEQ ID NO: 8816 - protein, 123 aa, Homo sapiens
  Heavy chain
QLQLQESGPGLVKPSETLSLTCTVSGGSISSSSYYWGWIRQPPGKGLEWIGSIYYSGSTYYNPSLKSRVTIPVDTSKTQFSLKLSSVTAADTAVYYCARIGRIAAAGSIDYWGQGTLVTVSSA

SEQ ID NO: 8817 - protein, 119 aa, Homo sapiens; identical to SEQ ID NO: 8777
  Heavy chain

SEQ ID NO: 8818 - protein, 119 aa, Homo sapiens
  Heavy chain
QVQLVESGGGVVQPGRSLRLSCAASGFTLSSYGMHWVRQAPGKGLEWVAVIWYDGSNKYYADSVKGRFTFSRDNSKNTLYLQMNSLRAEDTAVYYCARGGLTGAFDIWGQGTTVTVSSA

SEQ ID NO: 8819 - protein, 119 aa, Homo sapiens; identical to SEQ ID NO: 8775
  Heavy chain

SEQ ID NO: 8820 - protein, 117 aa, Homo sapiens
  Heavy chain
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARVGPHFDYWGQGTLVTVSSA

SEQ ID NO: 8821 - protein, 119 aa, Homo sapiens
  Heavy chain
QVQLVESGGGVVQPGRSLRLSCAASGFTFSSYGMHWVRQGPGKGLDWVAVVWYDGNNKHYADSVKGRFTISRDNSKNTLFLQMNSLRVEDTAVYYCARGGLLGSFDYWGQGTLVTVSSA

SEQ ID NO: 8822 - protein, 120 aa, Homo sapiens
  Heavy chain
QVQLVESGGGVVQPGRSLRLSCAASGFTFSSYGMHWVRQAPGKGLEWVAVIWYDGSNKHYADSVKGRLTISRDNSKNTLYLQMNSLRAEDTAVYYCARGANWGPHFDYWGRGTLVTVSSA

SEQ ID NO: 8823 - protein, 119 aa, Homo sapiens
  Heavy chain
QVQLVESGGGVVQPGRSLRLSCAASGFTFSSFGMHWVRQAPGKGLEWVAVIWYDGNNKYYADSVKGRFTISRDNSKNTLSLQMNSLRAEDTALYYCARGALLGAFDIWGQGTMVTVSSA

SEQ ID NO: 8824 - protein, 117 aa, Homo sapiens
  Heavy chain
QVQLVQSGAEVKKPGASVKVSCKASGYTFTNYGISWVRQAPGQGLEWMGWISVYNGNTNYAQKLQGRVTMTTDTSTSTAYMELRSLRSDDTAVYYCARGPPTLHYWGQGTLVTVSSA

SEQ ID NO: 8825 - protein, 121 aa, Homo sapiens
  Heavy chain
QVQLVESGGGVVQPGRSLRLSCAASGFTFSSYGMHWVRQAPGKGLEWVAVLWYDGSNNYFADSVKGRFTISRDNSKNTLYLHMNSLRAEDTAVYYCARGGLWFGEFLDYWGQGTLVTVSSA

SEQ ID NO: 8826 - protein, 119 aa, Homo sapiens
  Heavy chain
QVQLVESGGGVVQPGRSLRLSCAASGFTFSSYGMHWVRQAPGKGLEWVAVVWYDGNNKHYADSVKGRFTISRDNSKNTLYLQMNSLRAEDTAVYYCVRGDLLGSFDYWGQGTLVTVSSA

SEQ ID NO: 8827 - protein, 125 aa, Homo sapiens
  Heavy chain
QVQLQQSGPGLVKPSQTLSLTCAISGDSVSSNRAAWNWIRQSPSRGLEWLGRTYYRSKWYNDYAVSVKSRITINPDTSKNQFSLQLNSVTPEDTAVYYCARDKVLLWFGEFDYWGQGTLVTVSSA

SEQ ID NO: 8828 - protein, 121 aa, Homo sapiens
  Heavy chain
EVQLVESGGGLVQPGRSQRLSCTASGFTFGDYAMTWIRQAPGKGLEWVGFIRSKTYGGTTEYAASVRDRFTISRDDSKSIAYLQMKSLKTEDTAVYYCSFRYTYGPFDYWGQGTLVTVSSA

SEQ ID NO: 8829 - protein, 119 aa, Homo sapiens
  Heavy chain
QVQLVESGGGVVQPGRSLRLSCAASGFTFSSYGMHWVRQAPGKGLEWVAVIWYDGSNKHYADSVKGRFIISRDNSKNTLYLQMNSLRAEDTAVYYCVRSGLVTPFDYWGQGTLVTVSSA

SEQ ID NO: 8830 - protein, 118 aa, Homo sapiens
  Heavy chain
QVQLVQSGAEVKKPGASVKVSCKASGYTFTSYGIGWVRQAPGQGLEWMGWISAYNGNTNYAQKLQGRVTMTTDTSTSTAYMELRSLRSDDTAVYYCARVGGATIDYWGQGTLVTVSSA

SEQ ID NO: 8831 - protein, 119 aa, Homo sapiens
  Heavy chain
QVQLVESGGGVVQPGRSLRLSCAASGFTFRSYGMHWVRQAPGKGLEWVAVTWYDGSNKNYADSVKGRFTISRDNSKNTLYLQMNSLRAEDTAVYYCARGGLTGDFNYWGQGTLVTVSLA

SEQ ID NO: 8832 - protein, 119 aa, Homo sapiens
  Heavy chain
QVQLVESGGGVVQPGRSLRLSCAASGFTFSSYGMHWVRQAPGKGLEWVAVIWYDGNNKHYADSVKGRSTISRDNSKNTLYLQMNSLRAEDTAVYYCARGGLLGCFDYWGQGTLVTVSSA

SEQ ID NO: 8833 - protein, 123 aa, Homo sapiens
  Heavy chain
QVQLQESGPGLVKPSETLSLTCTVSGVSISSYYWNWIRQPPGKGLEWLGYIYHSGSTNYNPSLKSRVTISVDTSKNQFSLKLSSVTAADTAVYYCARGGGLLWFGGIGMDVWGQGTEVTVSSA

SEQ ID NO: 8834 - protein, 119 aa, Homo sapiens
  Heavy chain
QVQLVESGGGVVQPGRSLRLSCAASGFTFSSYGMHWVRQAPGKGLEWVAVIWYDGSNKHYADSVEGRSTISRDNSKNTLYLQMNSLRAEDTAVYYCSRGELLGYFDYWGQGTLVTVSSA

SEQ ID NO: 8835 - protein, 119 aa, Homo sapiens; identical to SEQ ID NO: 8735
  Heavy chain

SEQ ID NO: 8836 - protein, 119 aa, Homo sapiens; identical to SEQ ID NO: 8779
  Heavy chain

SEQ ID NO: 8837 - protein, 119 aa, Homo sapiens
  Heavy chain
QVQLVESGGGVVQPGRSLRLSCAASGFTFSSYGMHWVRQAPGKGLEWVAVTWYDGSNKHCADSVKGRFTISRDNSKNTLYLQMNSLRAEDSAVYYCARGELLGYLDYWGQGTLVTVSSA

SEQ ID NO: 8838 - protein, 119 aa, Homo sapiens
  Heavy chain
QVQLVESGGGVVQPGRSLRLSCAASGFTFSSYGIHWVRQAPGKGLEWVAVIWYDGSNKHYADSVKGRFTISRDNSKNTLDLQMNSLRAEDTAVYYCARGGYFGCFDFWGQGTLVTVSSA

SEQ ID NO: 8839 - protein, 123 aa, Homo sapiens; identical to SEQ ID NO: 8812
  Heavy chain

SEQ ID NO: 8840 - protein, 119 aa, Homo sapiens; identical to SEQ ID NO: 8797
  Heavy chain

SEQ ID NO: 8841 - protein, 119 aa, Homo sapiens
  Heavy chain
QVQLVESGGGVVQPGGSLRLSCAASGFTFSSYGMHWVRQAPGKGLEWVTVMWYDGSNKHYADSVKGRFTISRDNSKNTLYLQMNSLRAEDTAVYYCVRGELLGYFDNWGQGTLVTVSSA

SEQ ID NO: 8842 - protein, 119 aa, Homo sapiens; identical to SEQ ID NO: 8773
  Heavy chain

SEQ ID NO: 8843 - protein, 119 aa, Homo sapiens; identical to SEQ ID NO: 8772
  Heavy chain

SEQ ID NO: 8844 - protein, 119 aa, Homo sapiens
  Heavy chain
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCLTVAGPHVFDYWGQGTLVTVSSA

SEQ ID NO: 8845 - protein, 119 aa, Homo sapiens; identical to SEQ ID NO: 8773
  Heavy chain

SEQ ID NO: 8846 - protein, 119 aa, Homo sapiens; identical to SEQ ID NO: 8735
  Heavy chain

SEQ ID NO: 8847 - protein, 119 aa, Homo sapiens
  Heavy chain
QVQLVESGGGVVQPGSSLRLSCAASGFTFSSHGMHWVRQAPGKGLEWVAVIWYDGSNKHYADSVKGRFTTSRDNSKNTLHLQMNSLRAEDTAVYFCARGGYFGCFDYWGQGTLVTVSSA

SEQ ID NO: 8848 - protein, 119 aa, Homo sapiens
  Heavy chain
QVQLVESGGGVVQPGRSLRLSCAASGFTFSSYGMHWVRQAPGKGLEWVAVIWYDGSNKHYADSVKGRFTISRDNSKNTLYLQMNSLRAEDTAVYYCARGSKLGPFDYWGQGTLVTVSSA

SEQ ID NO: 8849 - protein, 119 aa, Homo sapiens
  Heavy chain
QVQLVESGGGVVQPGRSLRLSCAASGFTFSSYGIHWVRQAPGKGLEWVAVIWYDGSNKHYADSVKGRFTISRDNSKNTLYLEMNSLRAEDTAVYYCARGGYFGCFDQWGQGTLVTVSSA

SEQ ID NO: 8850 - protein, 119 aa, Homo sapiens; identical to SEQ ID NO: 8847
  Heavy chain

SEQ ID NO: 8851 - protein, 119 aa, Homo sapiens
  Heavy chain
QVQLVESGGGVVQPGRSLRLSCAASGFTFSSYGIHWVRQAPGKGLEWVAVIWYDGSNKHYADSVRGRSTISRDNSKNTLYLQMNSLRAEDTAVYFCARGDLLGYFDYWGQGTLVTVSSA

SEQ ID NO: 8852 - protein, 119 aa, Homo sapiens
  Heavy chain
QVQLVESGGGVVQPGRSLRLSCAASGFTFSSYGIHWVRQAPGKGLEWVAVIWYDGSNKNYADSVKGRFTISRDNSKNTLYLQMNSLRAEDTAVYYCARGELLGYFDYWGQGTLVTVSSA

SEQ ID NO: 8853 - protein, 119 aa, Homo sapiens
  Heavy chain
QVQLVESGGGVVQPGRSLRLSCAASGFTFSSYGTHWVRQAPGKGLEWVAVIWYDGSNKYYADSVKGRFTISRDNSKNTLYLQMNSLRAEDTAIYYCARAGNWGAFDIWGQGTMVTVSSA

SEQ ID NO: 8854 - protein, 119 aa, Homo sapiens
  Heavy chain
QVQLVESGGGVVQPGRSLRLSCAASGFTFSSYGMHWVRQAPGKGLEWVAVMWYDGSNKHCADSVKGRFTISRDNSKNTLYLQMNSLRAEDTAVYYCVRGELLGYFDNWGQGTLVTVSSA

SEQ ID NO: 8855 - protein, 119 aa, Homo sapiens; identical to SEQ ID NO: 8740
  Heavy chain

SEQ ID NO: 8856 - protein, 119 aa, Homo sapiens
  Heavy chain
QVQLVESGGGVVQPGKSLRLSCAASGFTFSSYGIHWVRQAPGKGLEWVAVIWYDGSNKHYADSVKGRFTISRDNSKNTLYLQMNSLRAEDTAVYYCARGELLGYFDNWGQGTLVTVSSA

SEQ ID NO: 8857 - protein, 122 aa, Homo sapiens
  Heavy chain
QVQLVESGGGVVQPGRSLRLSCAASGFTFSNYAMHWVRQAPGKGLEWVAVVWYDGNHKYYADSVRGRFTISRDNSNNTLYLQMNSLRAEDTAVYYCAREKGSGWYEGMDVWGQGTTVTVSSA

SEQ ID NO: 8858 - protein, 119 aa, Homo sapiens
  Heavy chain
QVQLVESGGGVVQPGRSLRLSCAASGFTFSSYGMHWVRQAPGKGLEWVAVIWYDGSNKHYADSVKGRFTISRDNSKNTLYLQMNSLRAEDTAVYYCARGAKLGPFDYWGQGTLVTVSSA

SEQ ID NO: 8859 - protein, 119 aa, Homo sapiens
  Heavy chain
QVQLVESGGGVVQPGMSLRLSCAASGFTFSSYGMHWVRQAPGKGLEWVAVIWYDGNNRHYADSVKGRFTISRDSSKNTLYLQMNSLRAEDTAVYYCARGGRLGAFDYWGQGTLVTVSSA

SEQ ID NO: 8860 - protein, 119 aa, Homo sapiens
  Heavy chain
QVQLVESGGGVVQPGRSLRLSCAASGFTFSSYGMHWVRQAPGKGLEWVAVIWYDGSNKYYADSVKGRFTISRDKSKNTLYLQMNSLRAEDTAVHYCARGGYLGAFDIWGQGTMVTVSSA

SEQ ID NO: 8861 - protein, 119 aa, Homo sapiens
  Heavy chain
QVQLVESGGGVVQPGRSLRLSCAASGFTFSSHGMHWVRQAPGKGLEWVAVTWYDGSNKHYADSVKGRATISRDNSKNTLYLQMNSLRAEDTAVYYCTRGELLGHFDYWGQGTLVTVSSA

SEQ ID NO: 8862 - protein, 119 aa, Homo sapiens
  Heavy chain
QVQLVESGGGVVQPGRSLRLSCAASGFTFSSYGIHWVRQAPGKGLEWVAVIWYDGSNKHYADSVKGRFTISRDNSKNTLYLEMNSLRAEDTAVYYCARGGYFGCFDPWGQGTLVTVSSA

SEQ ID NO: 8863 - protein, 119 aa, Homo sapiens
  Heavy chain
QVQLVESGGGVVQPGSSLRLSCAASGFTFSSHGMHWVRQAPGKGLEWVAVIWYDGSNKHYADSVKGRFTTSRDNSKNTLHLQMNSLRAEDTAVYFCARGGYFGCFDSWGQGTLVTVSSA

SEQ ID NO: 8864 - protein, 119 aa, Homo sapiens; identical to SEQ ID NO: 8852
  Heavy chain

SEQ ID NO: 8865 - protein, 119 aa, Homo sapiens; identical to SEQ ID NO: 8847
  Heavy chain

SEQ ID NO: 8866 - protein, 119 aa, Homo sapiens
  Heavy chain
QVQLVESGGGVVQPGRSLRLSCAASGFTFSSHGMHWVRQAPGKGLEWVAVTWYDGSNKHYADSVKGRATISRDNSKNTLYLQMNSLRAEDTAVYYCTRGELLGYVDYWGQGTLVTVSSA

SEQ ID NO: 8867 - protein, 119 aa, Homo sapiens; identical to SEQ ID NO: 8735
  Heavy chain

SEQ ID NO: 8868 - protein, 119 aa, Homo sapiens
  Heavy chain
QVQLVESGGGVVQPGSSLRLSCAASGFTFSSHGMHWVRQAPGKGLEWVAVIWYDGSNKHYADSVKGRFTTSRDNSKNTLHLQMNSLRAEDTAVYFCARGGYFGCVDYWGQGTLVTVSSA

SEQ ID NO: 8869 - protein, 119 aa, Homo sapiens
  Heavy chain
QVQLVESGGGVVQPGRSLRLSCAASGFTFSSHGMHWVRQAPGKGLEWVAVTWYDGSNKHYADSVKGRATISRDNSKNTLYLQMNSLRAEDTAVYYCTRGDLLGYFDYWGRGTLVTVSSA

SEQ ID NO: 8870 - protein, 123 aa, Homo sapiens
  Heavy chain
QVQLVESGGGVVQPGRSLRLSCAASGFTFSSYGMHWVRQAPGKGLEWVAVIWYDGRNKDYADSVKGRITISRDNSKNTLYLQMNSLRAEDTAVYYCARGGLLGPYFDYWGQGTLVTVSSAKTT

SEQ ID NO: 8871 - protein, 123 aa, Homo sapiens
  Heavy chain
QVQLVESGGGVVQPGRSLRLSCAASGFTFSSYGMNWVRQAPGKGLEWVAVIWYDGRNKHYADSVKGRFTISRDNSKNTLYLQMNSLRAEDTAVYYCARGGDWGPYFDYWGQGTLVTVSSAKTT

SEQ ID NO: 8872 - protein, 123 aa, Homo sapiens
  Heavy chain
QVQLVESGGGVVQPGRSLRLSCIASGFTFSSYGMHWVRQAPGKGLEWVAVNWYDGSNKHYADSVKGRFTISRDNSKNTLYLQMNSLRAEDTAVYYCARGGVWGPYFDYWGQGTLVTVSSAKTT

SEQ ID NO: 8873 - protein, 122 aa, Homo sapiens
  Heavy chain
QVQLVESGGGVVQPGRSLRLSCAASGFTFSSYGMHWVRQAPGTGLEWVAVIWYEGRNKYYADPVKGRFTISRDNSKNTLYLQMNSLRDDDTAVYYCARAGDLGAFDIWGQGTMVTVSSAKTT

SEQ ID NO: 8874 - protein, 121 aa, Homo sapiens
  Heavy chain
QVQLVQSGAEVKKPGASVKVSCKASGYTFTDYGISWVRQAPGQGLECMGWISAYNGNTNYAQNLQGRVTMTTDTSTNTAYMELRSLRSDDTAVYYCARVGAGDWDYWGQGTLVTVSSAKTT

SEQ ID NO: 8875 - protein, 122 aa, Homo sapiens
  Heavy chain
QVQLVESGGGVVQPGRSLRLSCAASGFTLSSFGMHWVRQAPGKGLEWVAVIWYDGSNKYYADSVKGRFIISRDNSKTALYLQMNSLRAEDTAVYYCARAHYFGAFDIWGQGTMVTVSSAKTT

SEQ ID NO: 8876 - protein, 122 aa, Homo sapiens
  Heavy chain
EVQLVESGGGLVQPGGSLRLSCAASGFTFSNYAMSWVRQAPGKGLEWVSAISGGGLSTYYADSVKGRFTISRDNSKNTLYLQMNSLRAEDTAVYYCAKDLLWLGFDYWGQGTLVTVSSAKTT

SEQ ID NO: 8877 - protein, 123 aa, Homo sapiens; identical to SEQ ID NO: 8871
  Heavy chain

SEQ ID NO: 8878 - protein, 122 aa, Homo sapiens
  Heavy chain
QVQLVESGGGVVQPGRSLRLSCAASGFTFRSYGMHWVRQAPGKGLEWVAVIWYDGSNKHYADSVKGRFTISRDNSKNTLYLQMNSLRAEDTAVYYCARNGLIGAFDIWGQGTMVTVSSAKTT

SEQ ID NO: 8879 - protein, 122 aa, Homo sapiens
  Heavy chain
QVQLVESGGGVVQPGRSLRLSCAASGFTFSSYGIHWVRQAPGKGLEWVAVIWYEGSNKFYADSVKGRFTISRDNSKNTLSLQMNSLRAEDTAVYYCARAGHLGAFDIWGQGTMVTVSSAKTT

SEQ ID NO: 8880 - protein, 122 aa, Homo sapiens; identical to SEQ ID NO: 8873
  Heavy chain

SEQ ID NO: 8881 - protein, 122 aa, Homo sapiens
  Heavy chain
EVQLVESGGGLVQPGGSLRLSCAASGFTFSSYAMSWVRQAPGKGLEWVSGISGSGGSTYYADSVKGRFTISRDNSKNTLYLQMNSLRAEDTAVYYCAKLGIAWYFDVWGRGTLVTVSSAKTT

SEQ ID NO: 8882 - protein, 122 aa, Homo sapiens
  Heavy chain
QVQLVESGGGVVQPGRSLRLSCAASGFTFSSYGIHWVRQAPGKGLEWVAVIWYDGSNKYYADSVKGRFTISRDNSKNTLYLQMNSLRAEDTAVYYCARAGDLAAFDIWGQGTMVTVSSAKTT

SEQ ID NO: 8883 - protein, 122 aa, Homo sapiens
  Heavy chain
QVQLVESGGGVVQPGRSLRLSCAASGFTFSRFGMHWVRQAPGKGLEWVAVIWYDGSNKHYADSVKDRFTISRDNSKNTLSLQMNSLRAEDTAVYYCARGGQLGPFDYWGQGILVTVSSAKTT

SEQ ID NO: 8884 - protein, 120 aa, Homo sapiens
  Heavy chain
QVQLVQSGAEVKKPGASVKVSCKASGYTFNYYGISWVRQAPGQGLEWMGWISVYNGNTNYVKKFQGRVTMTTDTSTNTAYMELRSLRSDDTAVYYCARWVRGVDYWGQGTLVTVSSAKTT

SEQ ID NO: 8885 - protein, 123 aa, Homo sapiens
  Heavy chain
QVQLVESGGGVVQPGRSLRLSCAASGFTLSSFGMHWVRQAPGKGLEWVAVIWYDGRNKYYEDSVKGRFTISRDNSNNTLYLQMNSLRAEDTAVYYCARGEYFGEFFDYWGQGTLVTVSSAKTT

SEQ ID NO: 8886 - protein, 122 aa, Homo sapiens
  Heavy chain
QVQLVESGGGVVQPGRSLRLSCAASGFTFSNYGIHWVRQTPGKGLEWVAVIWYDGSNRYYADSVKGRFTVSGDNSKNTLYLQMNSLRAEDTAVYYCARASLTGSFDYWGQGTLVTVSSAKTT

SEQ ID NO: 8887 - protein, 122 aa, Homo sapiens
  Heavy chain
QVQLVESGGGVVQPGRSLRLSCAASGFTFNSYGVHWVRQAPGKGLEWVAVIWYEGSNKFYADSVKGRFTISRDNSKNTLFLQMNSLRAEDTAVYYCVRAGYLGAFDIWGQGTMVTVSSAKTT

SEQ ID NO: 8888 - protein, 127 aa, Homo sapiens
  Heavy chain
QVQLVESGGGVVQPGRSLRLSCAASGFTFSSYGMHWVRQAPGKGLEWVAVIWYDGSYKYYADSVKGRFTISRDDSKNTLYLQMSSLRAEDTAVYYCARAPHYAILTGYYEDYWGQGTLVTVSSAKTT

SEQ ID NO: 8889 - protein, 124 aa, Homo sapiens
  Heavy chain
QVQLVQSGAEVKKPGASVKVSCKASDYTFTYYGISWVRQAPGQGLEWMGWISAYNGNTNYAQKLQGRVTMTTDTSTNTAYLELRSLRSDDTAVYYCARDYYDSSGYFDYWGQGTLVTVSSAKTT

SEQ ID NO: 8890 - protein, 122 aa, Homo sapiens
  Heavy chain
QVQLVQSGAEVKKPGASVKVSCKASGYTFTSYGISWVRQAPGQGLEWMGWISAYNGNTYYAQKFQGRVTMTTDTSTSTAYVELRSLRSDDTAVYYCARVTGRDAFDIWGQGTMVTVSSAKTT

SEQ ID NO: 8891 - protein, 124 aa, Homo sapiens
  Heavy chain
QVQLVESGGGVVQPGRSLRLSCAASGFTFSSYGMHWVRQAPGKGLEWVAVIWYDGNNKYYADSVKGRFTISRDNSKNTLYLQMYSLRAEDTAVYYCARGGILAAGIFDYWGQGTLVTVSSAKTT

SEQ ID NO: 8892 - protein, 126 aa, Homo sapiens
  Heavy chain
QVQLVESGGGVVQPGRSLRLSCAASGFTFSSYGMHWVRQAPGKGLEWVAVIWYDGNNKYYADSVKGRFTISRDNSKNTLYLQMNSLRADDTAVYYCARMLRGAPYYYGMDVWGQGTTITVSSAKTT

SEQ ID NO: 8893 - protein, 122 aa, Homo sapiens; identical to SEQ ID NO: 8886
  Heavy chain

SEQ ID NO: 8894 - protein, 121 aa, Homo sapiens
  Heavy chain
QVQLVQSGAEVKKPGASVKVSCKASGYTFTSYGISWVRQAPGQGLECMGWISAYNGNTNYAQKFQGRVTMITDTSTSTAYMELRSLRSDDTAVYYCARVGPINLDYWGQGTLVTVSSAKTT

SEQ ID NO: 8895 - protein, 122 aa, Homo sapiens
  Heavy chain
QVQLVESGGGVVQPGRSLRLSCAASGFTFSSYGMHWVRQAPGKGLEWVAVIWYDGRNKHYADSVKGRFIISRDNSKNTLYLQMNSLRAEDTAVYYCARGSQLGPFDYWGQGTLVTVSSAKTT

SEQ ID NO: 8896 - protein, 123 aa, Homo sapiens; identical to SEQ ID NO: 8870
  Heavy chain

SEQ ID NO: 8897 - protein, 123 aa, Homo sapiens
  Heavy chain
QVQLVESGGGVVQPGRSLRLSCAASGFTFSSHGMHWVRQAPGKGLEWVAVIWYDGSNKHYADSVKGRFTISRDNSKNTLYLQMNSLRAEDTAVYYCARGDILTGYYGYWGQGTLVTVSSAKTT

SEQ ID NO: 8898 - protein, 123 aa, Homo sapiens
  Heavy chain
QVQLVESGGGVVQPGRSLRLSCTASGFTFSSYGMHWVRQAPGKGLEWVAVSWYDGSNKHYVDSVKGRFTISRDNSKNTLYLQMNSLRVEDTAVYYCARGGVWGSYFDYWGQGTLVTVSSAKTT

SEQ ID NO: 8899 - protein, 123 aa, Homo sapiens; identical to SEQ ID NO: 8870
  Heavy chain

SEQ ID NO: 8900 - protein, 121 aa, Homo sapiens
  Heavy chain
QVQLVQSGAEVKKPGASVKVSCKASGYTFTSYGISWVRQAPGQGLEWMGWISAYNGNTNYAQNLQGRVTMTTDTSTSTAYMELRSLRSDDTAVYYCARVGPTNLDYWGQGTLVTVSSAKTT

SEQ ID NO: 8901 - protein, 120 aa, Homo sapiens
  Heavy chain
QVQLVQSGDEVKKPGASVKVSCKASGYTFTSYGISWVRQAPGQGLEWMGWISAYNGNTNYAQKFQGRVTMTTDTSTSTAYMELRSLRSDDTAVYYCAKVSGYFDYWGQGTLVTVSSAKTT

SEQ ID NO: 8902 - protein, 127 aa, Homo sapiens
  Heavy chain
QVQLVESGGGVVQPGRSLRLSCAASGFTLSSYGMHWVRQAPGKGLEWVAVIWYDGSNKYYADSVKGRFTISRDNSKNTLYLQMNSLRAEDTAVYYCARAPHYGILTGYYEDYWGQGTLVTVSSAKTT

SEQ ID NO: 8903 - protein, 122 aa, Homo sapiens
  Heavy chain
QVQLVESGGGVVQPGRSLRLSCAASGFTFSSYGMHWVRQAPGKGLEWVAVIWYDGRNKYYADPVKGRFTISRDNSKNTLYLQMNSLRDEDTAVYYCARAGYLGAFDIWGQGTMVTVSSAKTT

SEQ ID NO: 8904 - protein, 122 aa, Homo sapiens
  Heavy chain
QVQLVESGGGVVQPGRSLRLSCAASGFTFSSYGMHWVRQAPGKGLEWVAVVLYDGNNKYYADSVKGRFTISRDNSKNTLYLQMNSLRAEDTAVYYCARGGLTGPFDYWGQGTLVTVSSAKTT

SEQ ID NO: 8905 - protein, 122 aa, Homo sapiens
  Heavy chain
QVQLVESGGGVVQPGRSLRLSCAASGFIFSSYGMHWVRQAPGKGLEWVAVIWYDGRNKNYVDSVKGRFTISRDNSKNTLYLEMNSLRAEDTAVYYCARGGYWGSFDYWGQGTLVTVSSAKTT

SEQ ID NO: 8906 - protein, 122 aa, Homo sapiens; identical to SEQ ID NO: 8875
  Heavy chain

SEQ ID NO: 8907 - protein, 121 aa, Homo sapiens
  Heavy chain
QVQLVQSGAEVKKPGASVKVSCKASGYTFTSYGIGWVRQAPGQGLEWMGWISAYNGNTNYAQKLQGRVTMTTDTSTSTAYMELRSLRSDDTAVYYCARVRGGGLDVWGQGTTVTVSSAKTT

SEQ ID NO: 8908 - protein, 122 aa, Homo sapiens
  Heavy chain
QVQLVESGGGVVQPGRSLRISCAASGFTFSSYGIHWVRQAPGKGLQWVAVIWYDGRNKYYADSVKGRFTISRDNSKNTLYLQMNSLRAEDTAVYYCSRSGSFGAFDIWGQGTMVTVSSAKTT

SEQ ID NO: 8909 - protein, 124 aa, Homo sapiens; identical to SEQ ID NO: 8891
  Heavy chain

SEQ ID NO: 8910 - protein, 122 aa, Homo sapiens
  Heavy chain
QVQLVESGGGVVQPGRSLRLSCAASGFTFSRYGMHWVRQAPGKGLEWVAVIWYDGRNKYYADSVKGRFTISRDNSKNTLYLQMNSLRAEDTALYSCARAGELGPFDYWGQGTLVTVSSAKTT

SEQ ID NO: 8911 - protein, 124 aa, Homo sapiens
  Heavy chain
QVQLVESGGGVVQPGRSLRLSCAASGFTFSSYGMHWVRQAPGKGLEWVAVIWYDGNNKYYADSVKGRFTISRDNSKNTLYLQMNGLRAEDTAMYYCVRGSIVAAGLFDYWGQGTLVTVSSAKTT

SEQ ID NO: 8912 - protein, 126 aa, Homo sapiens
  Heavy chain
QVQLVESGGGVVQPGRSLRLSCAASGFTFSSYGMHWVRQAPGKGLEWVAVIWYDVGNKYYIDSVKGRFTISRDNSKNTLYLQMNSLRAEDTAVYYCARDYYGSGSPRHFDYWGQGTLVTVSSAKTT

SEQ ID NO: 8913 - protein, 122 aa, Homo sapiens
  Heavy chain
QVQLVESGGGVVQPGRSLRLSCAASGFTFSSYGMNWVRQAPGKGLEWVAVIWYDGSNKHYADSVKGRFTISRDNSKNTLYLQMNSLRAEDTAVYYCARVHYFGAFDIWGQGTMVTVSSAKTT

SEQ ID NO: 8914 - protein, 121 aa, Homo sapiens
  Heavy chain
QVQLVQSGAEVKKPGASVKVSCKASGYTFTNYGISWVRQAPGQGLECMGWISAYNGNTNYAQKFQGRVTMTTDTSTSTAYMELRSLRSDDTAVYYCARVAAAGFDYWGQGTLVAVSSAKTT

SEQ ID NO: 8915 - protein, 122 aa, Homo sapiens
  Heavy chain
QVQLVESGGGVVQPGRSLRLSCAASGFTFSSHGMHWVRQAPGKGLEWVAVIWYDGINKYYADSVRGRFTISRDNSNNTLYLQLNSLRAEDTAVYYCARNSLLTGWDYWGQGTLVTVSSAKTT

SEQ ID NO: 8916 - protein, 123 aa, Homo sapiens; identical to SEQ ID NO: 8870
  Heavy chain

SEQ ID NO: 8917 - protein, 121 aa, Homo sapiens
  Heavy chain
QVQLVQSGAEVKKPGASVKVSCKASGYTFTNYGISWVRQAPGQGLEWMGWISVYNGNTNYAQKFQGRVTMTTDTSTSTAYMELRSLISDDTAVYYCARLGKGLFDYWGQGTLVTVSSAKTT

SEQ ID NO: 8918 - protein, 123 aa, Homo sapiens; identical to SEQ ID NO: 8898
  Heavy chain

SEQ ID NO: 8919 - protein, 128 aa, Homo sapiens
  Heavy chain
QVQLVESGGGVVQPGRSLRLSCAASGFTFSSYGMHWVRQAPGKGLEWVAVIWYDGSNKYYADSVRGRFTISRDNSKNTLYLQMNSLRAEDTAVYYCARDRYDILTGPYWYFDLWGRGTLVTVSSAKTT

SEQ ID NO: 8920 - protein, 122 aa, Homo sapiens
  Heavy chain
QVQLVQSGAEVKKPGASVKVSCKASGYTFTNYGISWVRQAPGQGLEWMGWISVYNGNTNYVQKFQGRVTMSTDTSTNTAHMELRSLRSDDTAVYYCARVGVRGIFDYWGQGTLVTVSSAKTT

SEQ ID NO: 8921 - protein, 121 aa, Homo sapiens
  Heavy chain
QVQLVQSGAEVKKPGASVKVSCKASGYTFTSYGIGWVRQAPGQGLELMGWISAYNGNTNYAQKLQGRVTMTTDTSTNTAYMELRSLRSDDTAVYYCARVRGGGMDVWGQGTTVTVSSAKTT

SEQ ID NO: 8922 - protein, 123 aa, Homo sapiens; identical to SEQ ID NO: 8870
  Heavy chain

SEQ ID NO: 8923 - protein, 123 aa, Homo sapiens; identical to SEQ ID NO: 8872
  Heavy chain

SEQ ID NO: 8924 - protein, 124 aa, Homo sapiens
  Heavy chain
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARGGIVAAGILDYWGQGTLVTVSSAKTT

SEQ ID NO: 8925 - protein, 120 aa, Homo sapiens
  Heavy chain
QVQLVQSGAEVKKPGASVKVSCKASGYTFTNYGITWVRQAPGQGLEWMGWISAYNGNTNYAQKLQGRVTMTTDTSTSTAYMELRSLRSDDTAVYYCARVAPYFDYWGQGTLVTVSSAKTT

SEQ ID NO: 8926 - protein, 120 aa, Homo sapiens
  Heavy chain
QVQLVQSGAEVKKPGASVRVSCKASGYTFTSYGISWVRQAPGQGLEWMGWISAYNGNTNYAQKLQGRVTMTTDTSTSTAYMELRSLRSDDTAVYYCARFIYGMDVWGQGTTVTVSSAKTT

SEQ ID NO: 8927 - protein, 121 aa, Homo sapiens
  Heavy chain
QVQLVQSGAEVKKPGASVKVSCKASGYTFTSYGISWVRQAPGQGLECMGWISAYNGNTNYAQKLQGRVTMTTDTSTSTAYMELRSLRSDDTAVYYCARVGATNLDYWGQGTLVTVSSAKTT

SEQ ID NO: 8928 - protein, 122 aa, Homo sapiens
  Heavy chain
QVQLVESGGGVVQPGRSLRLSCAASGFTFSSNGMHWVRQAPGKGLEWVSVIWYDGNNKFYADSVKGRFTISRDNSKNTLYLQMNSLRAEDTAVYYCARAGHLGPFDYWGQGTLVTVSSAKTT

SEQ ID NO: 8929 - protein, 122 aa, Homo sapiens
  Heavy chain
QVQLVESGGGVVQPGRSLRLSCGASGFTFSSYGMHWVRQAPGKGLEWVAVIWYDGRNKYYEDSVKGRFTISRDNSKNTLYLQMNSLRAEDTAVYYCARAGLLGYFDYWGQGTLVTVSSAKTT

SEQ ID NO: 8930 - protein, 122 aa, Homo sapiens
  Heavy chain
QVQLVESGGGVVQPGRSLRLSCAASGFTFSSYGMHWVRQAPGKGLEWVAVIWYDGSNKFYADSVKGRFTISSDNSKNTRYLQMNSLRAEDTAVYYCARGGHLGSFDYWGQGTLVTVSSAKTT

SEQ ID NO: 8931 - protein, 121 aa, Homo sapiens
  Heavy chain
QVQLVQSGAEVKKPGASVKVSCKASGYTFTSYGIGWVRQAPGQGLEWMGWISAYNGNTNYAQKLQGRVTMTTDTSTSTAYMELRSLRSDDTAVYYCARVRGGGVDVWGQGTTVTVSSAKTT

SEQ ID NO: 8932 - protein, 122 aa, Homo sapiens
  Heavy chain
QVQLVESGGGVVQPGRSLRLSCAASGFTFSRYGMHWVRQAPGKGLEWVAVTWYDGSNKHYADSVRGRFTISRDNSKNTLYLQMNSLRAEDTAVYCCARSGSFGAFDIWGQGTMVTVSSAKTT

SEQ ID NO: 8933 - protein, 120 aa, Homo sapiens
  Heavy chain
QVQLVQSGAEVKKPGASVKVSCKASGYTFTNYGINWVRQAPGQGLEWMGWISAYNGNTNYAQKFQGRVTMTTDTSTSTAYMELRNLRSDDTAVYYCARLGHYIDYWGQGTLVTVSSAKTT

SEQ ID NO: 8934 - protein, 122 aa, Homo sapiens
  Heavy chain
QVQLVESGGGVVQPGRSLRLSCAATGFNFSSYGIHWVRLAPGKGLEWVAVIWYDGSNRYYADSVKGRFTISRDTSKNTLYLQMNSLRAEDTAVYYCARAGLWSAFDIWGRGTMVSVSSAKTT

SEQ ID NO: 8935 - protein, 122 aa, Homo sapiens
  Heavy chain
QVQLVESGGGVVQPGRSLRLSCAASGFTFSSYGIHWVRQAPGKGLEWVAVIWYDGRNKHYADSVKGRFTISRDNSKNTLYLQMNSLRAEDTAVYYCARQDYWGPFDYWGQGTLVTVSSAKTT

SEQ ID NO: 8936 - protein, 121 aa, Homo sapiens
  Heavy chain
QVQLVQSGAEVKKPGASVKVSCKASGYTFTSYGISWVRQAPGQGLECMGWISAYNGNTNYAQKLQGRVTMTTDTSTSTAYMELRSLRSDDTAVYYCARVGIGAFDIWGQGTMVTVSSAKTT

SEQ ID NO: 8937 - protein, 123 aa, Homo sapiens; identical to SEQ ID NO: 8871
  Heavy chain

SEQ ID NO: 8938 - protein, 127 aa, Homo sapiens
  Heavy chain
QVQLVESGGGVVQPGRSLRLSCAASGFTFSSYGMHWVRQAPGKGLEWVALIWYDGSYKYYADSVKGRFTISRDNSKNTLYLQMNSLRAEDTAVYYCASAYYDLLTGPYYFDYWGQGTLVTVSSAKTT

SEQ ID NO: 8939 - protein, 122 aa, Homo sapiens; identical to SEQ ID NO: 8873
  Heavy chain

SEQ ID NO: 8940 - protein, 123 aa, Homo sapiens
  Heavy chain
QVQLVESGGGVVQPGRSLRLSCAASGFTFSSYGMHWVRQAPGKGLEWVAVIWYDGRNKHYADSVKGRFTISRDNSKNTLYLQMNSLRAEDTAVYYCARGEWFGEFFDYWGQGTLVTVSSAKTT

SEQ ID NO: 8941 - protein, 121 aa, Homo sapiens
  Heavy chain
QVQLVESGGGVVQPGRSLRLSCAASGFTFRSYGMHWVRQAPGKGLEWVAVIWYDGRNKHYADSVKGRFTISRDNSKNTLYLQMNSLRAEDTAVYYCARSIVGAFDYWGQGTLVTVSSAKTT

SEQ ID NO: 8942 - protein, 122 aa, Homo sapiens
  Heavy chain
QVQLVESGGGVVQPGRSLRLSCEASGFTFSSHGMHWVRQAPGKGLEWVAVIWYDGSNKHYADFVKGRFTISRDNSKNTLYLQVNSLRAEDTAVYYCARGHYFGAFDIWGQGTMVTVSSAKTT

SEQ ID NO: 8943 - protein, 123 aa, Homo sapiens; identical to SEQ ID NO: 8870
  Heavy chain

SEQ ID NO: 8944 - protein, 125 aa, Homo sapiens
  Heavy chain
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAREDYYGSGRNYYGMDVWGQGTTVTVSSA

SEQ ID NO: 8945 - protein, 122 aa, Homo sapiens; identical to SEQ ID NO: 8910
  Heavy chain

SEQ ID NO: 8946 - protein, 122 aa, Homo sapiens
  Heavy chain
QVQLVESGGGVVQPGRSLRLSCEASGFTFSSYGMNWVRQAPGKGLEWVAVIWYDGRNKHYTDSVKGRFTISRDNSKNTLYLQMNSLRAEDTAVYYCARAHYFGAFDIWGQGTMVTVSSAKTT

SEQ ID NO: 8947 - protein, 123 aa, Homo sapiens
  Heavy chain
QVQLVESGGGVVQPGRSLRLSCAASGFTFSNYGMNWVRQAPGKGLEWVAVIWYDGRNKHYADSVKGRFTISRDNSKNTLYLQMNSLRAEDTAVYYCARGGDWGPYFDYWGQGTLVTVSSAKTT

SEQ ID NO: 8948 - protein, 122 aa, Homo sapiens; identical to SEQ ID NO: 8873
  Heavy chain

SEQ ID NO: 8949 - protein, 123 aa, Homo sapiens
  Heavy chain
QVQLVESGGGVVQPGRSLRLSCAASGFTLSNYGMHWVRQAPGKGLEWVAVIWYDGRNKHYADSVEGRFTLSRDNSKNTLYLQMNSLRAEDTAVYYCARGGVWGSYFDYWGQGTLVTVSSAKTT

SEQ ID NO: 8950 - protein, 122 aa, Homo sapiens
  Heavy chain
QVQLVESGGGVVQPGRSLRLSCAASGFTFSSYGIHWVRQAPGKGLEWVAVIWYDGSNKYYADSVKGRFTISRDNSKNTLYLQMNSLRAEDTAVYYCARGSLLGPFDYWGQGTLVTVSSAKTT

SEQ ID NO: 8951 - protein, 120 aa, Homo sapiens
  Heavy chain
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCGRWVRGVEYWGQGTLVTVSSAKTT

SEQ ID NO: 8952 - protein, 123 aa, Homo sapiens; identical to SEQ ID NO: 8947
  Heavy chain

SEQ ID NO: 8953 - protein, 126 aa, Homo sapiens
  Heavy chain
QVQLVESGGGVVQPGRSLRLSCAASGFTFSSYGMHWVRQAPGKGLEWVAVIWFDGNNKYYADSVKGRFTISRDNSKNTLYLQMNSLRADDTAVYYCARMLRGAPYYYGMDVWGQGTTITVSSAKTT

SEQ ID NO: 8954 - protein, 123 aa, Homo sapiens
  Heavy chain
QVQLVESGGGVVQPGRSLRLSCAASGFTFSSFGMHWVRQAPGKGLEWVAVIWYDGRNKYYVDSVKGRFTISRDNSNNTLYLQMNSLRAEDTAVYYCARGEFFGEFFDYWGQGTLVTVSSAKTT

SEQ ID NO: 8955 - protein, 122 aa, Homo sapiens; identical to SEQ ID NO: 8873
  Heavy chain

SEQ ID NO: 8956 - protein, 127 aa, Homo sapiens
  Heavy chain
QVQLVQSGAEVKKPGASVKVSCKASGYTFTSYYMHWVRQAPGQGLEWMGIINPSVGSTSYAQKFQGRVTMTRDTSTSTVYMELSSLRSEDTAVYYCAREVRVRGVIIPFFDYWDQGTLVTVSSAKTT

SEQ ID NO: 8957 - protein, 127 aa, Homo sapiens; identical to SEQ ID NO: 8956
  Heavy chain

SEQ ID NO: 8958 - protein, 131 aa, Homo sapiens
  Heavy chain
QLQLQESGPGLVKPSETLSLTCTVSGGSISSSSYYWGWIRQPPGKGLEWIGSIYYSGSTYYNPSLKSRVTISVDTSKNQFSLKLSSVTAADTAVYYCAGTYYYGSGSYSGYYYYYGMDVWGQGTTVTVSSA

SEQ ID NO: 8959 - protein, 123 aa, Homo sapiens; identical to SEQ ID NO: 8949
  Heavy chain

SEQ ID NO: 8960 - protein, 122 aa, Homo sapiens
  Heavy chain
QVQLVESGGGVVQPGRSLRLSCAASGFTFSSYGMHWVRQAPGKGLEWVAVIWYDGSNKYYADSVKGRFTISRDISKNTLYLQMNSLRAEDTSVYYCARGGLLGPFDYWGQGTLVTVSSAKTT

SEQ ID NO: 8961 - protein, 122 aa, Homo sapiens
  Heavy chain
QVQLVESGGGVVQPGRSLRLSCAASGFTFSSYGMHWVRQAPGKGLEWVAVIWYEGSNKYYADSVKGRFTISRDNSKNTLYLQMNSLRAEDTALYYCARAGLLGYFDYWGQGTLVTVSSAKTT

SEQ ID NO: 8962 - protein, 122 aa, Homo sapiens
  Heavy chain
QVQLVESGGGVVQPGRSLRLSCAASGFTFSSYGIHWVRQAPGKGLEWVAVIWYDGSNKHYADSVKGRFTISRDNSKNTLYLQMNSLRDEDTAVYYCARGGLIGPFDYWGQGTLVTVSSAKTT

SEQ ID NO: 8963 - protein, 122 aa, Homo sapiens
  Heavy chain
QVQLVESGGGVVQPGRSLRLSCAASGFTFSSYGMHWVRQAPGKGLEWVAVIWYDGSNKFYADSVKGRFTISSDNSKNTLYLQMNSLRAEDTAVYYCARGGHLGSFDYWGQGTLVTVSSAKTT

SEQ ID NO: 8964 - protein, 122 aa, Homo sapiens
  Heavy chain
QVQLVESGGGVVQPGRSLRLSCAASGFTFSSYGMHWVRQAPGKGLEWVAVIWYDGSNKYYADSVKGRFTFSRDNSKNTLYLQMNSLRAEDTAVYYCARGGLMGAFDYWGQGTLVTVSSAKTT

SEQ ID NO: 8965 - protein, 123 aa, Homo sapiens; identical to SEQ ID NO: 8947
  Heavy chain

SEQ ID NO: 8966 - protein, 120 aa, Homo sapiens; identical to SEQ ID NO: 8951
  Heavy chain

SEQ ID NO: 8967 - protein, 122 aa, Homo sapiens
  Heavy chain
QVQLVESGGGVVQPGRSLRLSCAASGFTFSSYGMHWVRQAPGKGLEWVAVVWYDGSNKHYADSLKGRLTISRDNSKNTLYLQMNSLRAEDTAVFYCARAGHLGPFDYWGQGTLVTVSSAKTT

SEQ ID NO: 8968 - protein, 123 aa, Homo sapiens; identical to SEQ ID NO: 8870
  Heavy chain

SEQ ID NO: 8969 - protein, 127 aa, Homo sapiens
  Heavy chain
QVQLVESGGGVVQPGRSLRLSCAASGFTFSSYGMHWVRQAPGKGLEWVALIWYDGSYTYYADSVKGRFTISRDNSKNTLYLQMNSLRAEDTAVYYCASAYYDILTGPYYFDYWGQGTLVTVSSAKTT

SEQ ID NO: 8970 - protein, 123 aa, Homo sapiens; identical to SEQ ID NO: 8872
  Heavy chain

SEQ ID NO: 8971 - protein, 122 aa, Homo sapiens; identical to SEQ ID NO: 8910
  Heavy chain

SEQ ID NO: 8972 - protein, 123 aa, Homo sapiens; identical to SEQ ID NO: 8870
  Heavy chain

SEQ ID NO: 8973 - protein, 122 aa, Homo sapiens
  Heavy chain
QLQLQESGPGLVKPSETLSLTCTVSGGSISSSSYYWGWIRQPPGKGLEWIGSIYYRGNTYLNPSLKSRVTISVDTSKNQFSLKLRSVTAADTAVYYCARRSAYDPYYFDYWGQGTLVTVSSA

SEQ ID NO: 8974 - protein, 122 aa, Homo sapiens
  Heavy chain
QVQLVESGGGVVQPGRSLRLSCAASGFTFSSYGMHWVRQAPGKGLEWVAVIWYDGRNKYYADSVKGRFTISRDNSKNTLYLQMNSLRAEDTAVYYCARGGLTGPFDYWGQGTLVTVSSAKTT

SEQ ID NO: 8975 - protein, 120 aa, Homo sapiens; identical to SEQ ID NO: 8951
  Heavy chain

SEQ ID NO: 8976 - protein, 122 aa, Homo sapiens; identical to SEQ ID NO: 8946
  Heavy chain

SEQ ID NO: 8977 - protein, 120 aa, Homo sapiens; identical to SEQ ID NO: 8951
  Heavy chain

SEQ ID NO: 8978 - protein, 122 aa, Homo sapiens; identical to SEQ ID NO: 8946
  Heavy chain

SEQ ID NO: 8979 - protein, 123 aa, Homo sapiens; identical to SEQ ID NO: 8949
  Heavy chain

SEQ ID NO: 8980 - protein, 124 aa, Homo sapiens
  Heavy chain
QVQLVESGGGVVQPERSLRLSCAASGFTFSSHGMHWVRQAPGKGLEWVAVIWYDGNNKYYADSVKGRFTISRDNSKNTLYLQMNSLRAEDTAVYYCARGGILAAGIFDYWGQGTLVTVSSAKTT

SEQ ID NO: 8981 - protein, 124 aa, Homo sapiens
  Heavy chain
QVQLVESGGGVVQPGRSLRLSCAASGFTFSSYGMHWVRQAPGKGLEWVAVIWYDGSYKYYADSVKGRFTISRDNSKNTLYLQMNSLRAEDTAVYYCARGSVVAAGLFDYWGQGTLVTVSSAKTT

SEQ ID NO: 8982 - protein, 123 aa, Homo sapiens; identical to SEQ ID NO: 8949
  Heavy chain

SEQ ID NO: 8983 - protein, 122 aa, Homo sapiens; identical to SEQ ID NO: 8973
  Heavy chain

SEQ ID NO: 8984 - protein, 120 aa, Homo sapiens
  Heavy chain
QVQLVQSGAEVKKPGASVKVSCKTSGYTFTSYGITWVRQAPGQGLEWMGWISAYNGNTNYAQKLQGRVTMTTDTSTSTAYMELRSLRSDDTAVYYCAKVSGYFDYWGQGTLVTVSSAKTT

SEQ ID NO: 8985 - protein, 123 aa, Homo sapiens; identical to SEQ ID NO: 8949
  Heavy chain

SEQ ID NO: 8986 - protein, 123 aa, Homo sapiens; identical to SEQ ID NO: 8947
  Heavy chain

SEQ ID NO: 8987 - protein, 122 aa, Homo sapiens; identical to SEQ ID NO: 8873
  Heavy chain

SEQ ID NO: 8988 - protein, 122 aa, Homo sapiens
  Heavy chain
QVQLVESGGGVVQPGRSLRLSCAASGFTFSRYGMHWVRQAPGKGLEWVAVIWYDGSNKYYADSVKGRFTISRDNSKNTLYLQMNSLRAEDTAVYYCARAGHLGAFDIWGQGTMVTVSSAKTT

SEQ ID NO: 8989 - protein, 123 aa, Homo sapiens; identical to SEQ ID NO: 8947
  Heavy chain

SEQ ID NO: 8990 - protein, 122 aa, Homo sapiens; identical to SEQ ID NO: 8910
  Heavy chain

SEQ ID NO: 8991 - protein, 122 aa, Homo sapiens; identical to SEQ ID NO: 8910
  Heavy chain

SEQ ID NO: 8992 - protein, 6 aa, Homo sapiens
  Light chain CDR1
QSISSY

SEQ ID NO: 8993 - protein, 6 aa, Homo sapiens
  Light chain CDR1
QGISNY

SEQ ID NO: 8994 - protein, 6 aa, Homo sapiens
  Light chain CDR1
QSVSSN

SEQ ID NO: 8995 - protein, 6 aa, Homo sapiens
  Light chain CDR1
QGIRND

SEQ ID NO: 8996 - protein, 6 aa, Homo sapiens
  Light chain CDR1
QGIRND

SEQ ID NO: 8997 - protein, 6 aa, Homo sapiens
  Light chain CDR1
QGIRND

SEQ ID NO: 8998 - protein, 6 aa, Homo sapiens
  Light chain CDR1
QGISSY

SEQ ID NO: 8999 - protein, 7 aa, Homo sapiens
  Light chain CDR1
QSVSSSY

SEQ ID NO: 9000 - protein, 6 aa, Homo sapiens
  Light chain CDR1
QGIRND

SEQ ID NO: 9001 - protein, 6 aa, Homo sapiens
  Light chain CDR1
QGIRND

SEQ ID NO: 9002 - protein, 6 aa, Homo sapiens
  Light chain CDR1
QGIRND

SEQ ID NO: 9003 - protein, 6 aa, Homo sapiens
  Light chain CDR1
QVIRND

SEQ ID NO: 9004 - protein, 7 aa, Homo sapiens
  Light chain CDR1
QSVSSSY

SEQ ID NO: 9005 - protein, 7 aa, Homo sapiens
  Light chain CDR1
QSVSSSY

SEQ ID NO: 9006 - protein, 6 aa, Homo sapiens
  Light chain CDR1
QGISNY

SEQ ID NO: 9007 - protein, 6 aa, Homo sapiens
  Light chain CDR1
QGIRND

SEQ ID NO: 9008 - protein, 6 aa, Homo sapiens
  Light chain CDR1
QGIRND

SEQ ID NO: 9009 - protein, 6 aa, Homo sapiens
  Light chain CDR1
QSISSY

SEQ ID NO: 9010 - protein, 6 aa, Homo sapiens
  Light chain CDR1
QGISRY

SEQ ID NO: 9011 - protein, 6 aa, Homo sapiens
  Light chain CDR1
QSISSY

SEQ ID NO: 9012 - protein, 6 aa, Homo sapiens
  Light chain CDR1
QSISSY

SEQ ID NO: 9013 - protein, 6 aa, Homo sapiens
  Light chain CDR1
QSISSY

SEQ ID NO: 9014 - protein, 6 aa, Homo sapiens
  Light chain CDR1
QGISSY

SEQ ID NO: 9015 - protein, 6 aa, Homo sapiens
  Light chain CDR1
QSISSY

SEQ ID NO: 9016 - protein, 6 aa, Homo sapiens
  Light chain CDR1
QGISSY

SEQ ID NO: 9017 - protein, 6 aa, Homo sapiens
  Light chain CDR1
QSISSY

SEQ ID NO: 9018 - protein, 6 aa, Homo sapiens
  Light chain CDR1
QGIRND

SEQ ID NO: 9019 - protein, 6 aa, Homo sapiens
  Light chain CDR1
QGIRND

SEQ ID NO: 9020 - protein, 7 aa, Homo sapiens
  Light chain CDR1
QSVSSSY

SEQ ID NO: 9021 - protein, 6 aa, Homo sapiens
  Light chain CDR1
QSISSY

SEQ ID NO: 9022 - protein, 6 aa, Homo sapiens
  Light chain CDR1
QDIRND

SEQ ID NO: 9023 - protein, 7 aa, Homo sapiens
  Light chain CDR1
QSVSSSY

SEQ ID NO: 9024 - protein, 6 aa, Homo sapiens
  Light chain CDR1
QSISSY

SEQ ID NO: 9025 - protein, 6 aa, Homo sapiens
  Light chain CDR1
QSISSY

SEQ ID NO: 9026 - protein, 6 aa, Homo sapiens
  Light chain CDR1
QGIRND

SEQ ID NO: 9027 - protein, 6 aa, Homo sapiens
  Light chain CDR1
QGISSY

SEQ ID NO: 9028 - protein, 6 aa, Homo sapiens
  Light chain CDR1
QSISSY

SEQ ID NO: 9029 - protein, 6 aa, Homo sapiens
  Light chain CDR1
QSISSY

SEQ ID NO: 9030 - protein, 7 aa, Homo sapiens
  Light chain CDR1
QSVSSSY

SEQ ID NO: 9031 - protein, 6 aa, Homo sapiens
  Light chain CDR1
QGIRND

SEQ ID NO: 9032 - protein, 7 aa, Homo sapiens
  Light chain CDR1
QSVSSSY

SEQ ID NO: 9033 - protein, 6 aa, Homo sapiens
  Light chain CDR1
QGIRND

SEQ ID NO: 9034 - protein, 6 aa, Homo sapiens
  Light chain CDR1
QSISSY

SEQ ID NO: 9035 - protein, 7 aa, Homo sapiens
  Light chain CDR1
QSVSSSY

SEQ ID NO: 9036 - protein, 6 aa, Homo sapiens
  Light chain CDR1
QGISSY

SEQ ID NO: 9037 - protein, 6 aa, Homo sapiens
  Light chain CDR1
QGIRND

SEQ ID NO: 9038 - protein, 6 aa, Homo sapiens
  Light chain CDR1
QSISSY

SEQ ID NO: 9039 - protein, 6 aa, Homo sapiens
  Light chain CDR1
QSISSY

SEQ ID NO: 9040 - protein, 7 aa, Homo sapiens
  Light chain CDR1
QSVSSSY

SEQ ID NO: 9041 - protein, 7 aa, Homo sapiens
  Light chain CDR1
QSVSSSY

SEQ ID NO: 9042 - protein, 6 aa, Homo sapiens
  Light chain CDR1
QDISNY

SEQ ID NO: 9043 - protein, 7 aa, Homo sapiens
  Light chain CDR1
QSVSSSY

SEQ ID NO: 9044 - protein, 7 aa, Homo sapiens
  Light chain CDR1
QSVSSSY

SEQ ID NO: 9045 - protein, 11 aa, Homo sapiens
  Light chain CDR1
QSLLHSNGYNY

SEQ ID NO: 9046 - protein, 6 aa, Homo sapiens
  Light chain CDR1
QSISSY

SEQ ID NO: 9047 - protein, 7 aa, Homo sapiens
  Light chain CDR1
QSVSSSY

SEQ ID NO: 9048 - protein, 7 aa, Homo sapiens
  Light chain CDR1
QSVSSSY

SEQ ID NO: 9049 - protein, 7 aa, Homo sapiens
  Light chain CDR1
QSISSSY

SEQ ID NO: 9050 - protein, 6 aa, Homo sapiens
  Light chain CDR1
QSISSY

SEQ ID NO: 9051 - protein, 7 aa, Homo sapiens
  Light chain CDR1
QSVSSSS

SEQ ID NO: 9052 - protein, 6 aa, Homo sapiens
  Light chain CDR1
QSISSY

SEQ ID NO: 9053 - protein, 7 aa, Homo sapiens
  Light chain CDR1
QSVSSSY

SEQ ID NO: 9054 - protein, 7 aa, Homo sapiens
  Light chain CDR1
QSVSSSY

SEQ ID NO: 9055 - protein, 7 aa, Homo sapiens
  Light chain CDR1
QSVSSSY

SEQ ID NO: 9056 - protein, 7 aa, Homo sapiens
  Light chain CDR1
QSVSSSY

SEQ ID NO: 9057 - protein, 11 aa, Homo sapiens
  Light chain CDR1
QSLLHSNGYNY

SEQ ID NO: 9058 - protein, 7 aa, Homo sapiens
  Light chain CDR1
QSVSSSY

SEQ ID NO: 9059 - protein, 6 aa, Homo sapiens
  Light chain CDR1
QSISSY

SEQ ID NO: 9060 - protein, 6 aa, Homo sapiens
  Light chain CDR1
QSISSY

SEQ ID NO: 9061 - protein, 6 aa, Homo sapiens
  Light chain CDR1
QSISSF

SEQ ID NO: 9062 - protein, 7 aa, Homo sapiens
  Light chain CDR1
QSVSSSY

SEQ ID NO: 9063 - protein, 6 aa, Homo sapiens
  Light chain CDR1
QSISSF

SEQ ID NO: 9064 - protein, 6 aa, Homo sapiens
  Light chain CDR1
QSISSY

SEQ ID NO: 9065 - protein, 7 aa, Homo sapiens
  Light chain CDR1
QSVSSSY

SEQ ID NO: 9066 - protein, 6 aa, Homo sapiens
  Light chain CDR1
QSISSY

SEQ ID NO: 9067 - protein, 7 aa, Homo sapiens
  Light chain CDR1
QSVSSSY

SEQ ID NO: 9068 - protein, 6 aa, Homo sapiens
  Light chain CDR1
QSISSY

SEQ ID NO: 9069 - protein, 7 aa, Homo sapiens
  Light chain CDR1
QSVSSSY

SEQ ID NO: 9070 - protein, 7 aa, Homo sapiens
  Light chain CDR1
QSVSSSY

SEQ ID NO: 9071 - protein, 6 aa, Homo sapiens
  Light chain CDR1
QSISSY

SEQ ID NO: 9072 - protein, 6 aa, Homo sapiens
  Light chain CDR1
QSISSY

SEQ ID NO: 9073 - protein, 7 aa, Homo sapiens
  Light chain CDR1
QSVSSSY

SEQ ID NO: 9074 - protein, 6 aa, Homo sapiens
  Light chain CDR1
QGISSY

SEQ ID NO: 9075 - protein, 11 aa, Homo sapiens
  Light chain CDR1
QSLLHSNGYNY

SEQ ID NO: 9076 - protein, 7 aa, Homo sapiens
  Light chain CDR1
QSVSSSY

SEQ ID NO: 9077 - protein, 7 aa, Homo sapiens
  Light chain CDR1
QSVSSSY

SEQ ID NO: 9078 - protein, 7 aa, Homo sapiens
  Light chain CDR1
QRAGSSY

SEQ ID NO: 9079 - protein, 6 aa, Homo sapiens
  Light chain CDR1
QGIRND

SEQ ID NO: 9080 - protein, 6 aa, Homo sapiens
  Light chain CDR1
QGIRND

SEQ ID NO: 9081 - protein, 11 aa, Homo sapiens
  Light chain CDR1
QSLLHSNGYNY

SEQ ID NO: 9082 - protein, 7 aa, Homo sapiens
  Light chain CDR1
QSVSSSY

SEQ ID NO: 9083 - protein, 6 aa, Homo sapiens
  Light chain CDR1
QGIRND

SEQ ID NO: 9084 - protein, 6 aa, Homo sapiens
  Light chain CDR1
QGIRND

SEQ ID NO: 9085 - protein, 7 aa, Homo sapiens
  Light chain CDR1
QRAGSSY

SEQ ID NO: 9086 - protein, 6 aa, Homo sapiens
  Light chain CDR1
QGIRND

SEQ ID NO: 9087 - protein, 6 aa, Homo sapiens
  Light chain CDR1
QGIRND

SEQ ID NO: 9088 - protein, 6 aa, Homo sapiens
  Light chain CDR1
QGISSY

SEQ ID NO: 9089 - protein, 6 aa, Homo sapiens
  Light chain CDR1
QSISSY

SEQ ID NO: 9090 - protein, 6 aa, Homo sapiens
  Light chain CDR1
QGIRND

SEQ ID NO: 9091 - protein, 11 aa, Homo sapiens
  Light chain CDR1
QSLLHSNGYNY

SEQ ID NO: 9092 - protein, 6 aa, Homo sapiens
  Light chain CDR1
QGIRND

SEQ ID NO: 9093 - protein, 6 aa, Homo sapiens
  Light chain CDR1
QGIRND

SEQ ID NO: 9094 - protein, 6 aa, Homo sapiens
  Light chain CDR1
QGIRND

SEQ ID NO: 9095 - protein, 7 aa, Homo sapiens
  Light chain CDR1
QSVSSSY

SEQ ID NO: 9096 - protein, 6 aa, Homo sapiens
  Light chain CDR1
QGIRND

SEQ ID NO: 9097 - protein, 6 aa, Homo sapiens
  Light chain CDR1
QGISSY

SEQ ID NO: 9098 - protein, 6 aa, Homo sapiens
  Light chain CDR1
QGIRND

SEQ ID NO: 9099 - protein, 6 aa, Homo sapiens
  Light chain CDR1
QGIRSY

SEQ ID NO: 9100 - protein, 6 aa, Homo sapiens
  Light chain CDR1
QGIRND

SEQ ID NO: 9101 - protein, 6 aa, Homo sapiens
  Light chain CDR1
QGIRND

SEQ ID NO: 9102 - protein, 6 aa, Homo sapiens
  Light chain CDR1
QSISSY

SEQ ID NO: 9103 - protein, 7 aa, Homo sapiens
  Light chain CDR1
QSVSSSY

SEQ ID NO: 9104 - protein, 6 aa, Homo sapiens
  Light chain CDR1
QSISSY

SEQ ID NO: 9105 - protein, 6 aa, Homo sapiens
  Light chain CDR1
QSISSY

SEQ ID NO: 9106 - protein, 6 aa, Homo sapiens
  Light chain CDR1
QSISSY

SEQ ID NO: 9107 - protein, 6 aa, Homo sapiens
  Light chain CDR1
QGIRND

SEQ ID NO: 9108 - protein, 6 aa, Homo sapiens
  Light chain CDR1
QGIRND

SEQ ID NO: 9109 - protein, 6 aa, Homo sapiens
  Light chain CDR1
QGIRND

SEQ ID NO: 9110 - protein, 6 aa, Homo sapiens
  Light chain CDR1
QSISSY

SEQ ID NO: 9111 - protein, 7 aa, Homo sapiens
  Light chain CDR1
QRAGSSY

SEQ ID NO: 9112 - protein, 6 aa, Homo sapiens
  Light chain CDR1
QGIRND

SEQ ID NO: 9113 - protein, 7 aa, Homo sapiens
  Light chain CDR1
QSVSSSY

SEQ ID NO: 9114 - protein, 6 aa, Homo sapiens
  Light chain CDR1
QGIRND

SEQ ID NO: 9115 - protein, 6 aa, Homo sapiens
  Light chain CDR1
QGISSY

SEQ ID NO: 9116 - protein, 6 aa, Homo sapiens
  Light chain CDR1
QGIRND

SEQ ID NO: 9117 - protein, 6 aa, Homo sapiens
  Light chain CDR1
QGIRND

SEQ ID NO: 9118 - protein, 6 aa, Homo sapiens
  Light chain CDR1
QGISSY

SEQ ID NO: 9119 - protein, 7 aa, Homo sapiens
  Light chain CDR1
QSVSSSY

SEQ ID NO: 9120 - protein, 6 aa, Homo sapiens
  Light chain CDR1
QGISSY

SEQ ID NO: 9121 - protein, 11 aa, Homo sapiens
  Light chain CDR1
QSLLHSNGYNY

SEQ ID NO: 9122 - protein, 6 aa, Homo sapiens
  Light chain CDR1
QGIRND

SEQ ID NO: 9123 - protein, 7 aa, Homo sapiens
  Light chain CDR1
QSVSSSY

SEQ ID NO: 9124 - protein, 6 aa, Homo sapiens
  Light chain CDR1
QGISND

SEQ ID NO: 9125 - protein, 6 aa, Homo sapiens
  Light chain CDR1
QDITND

SEQ ID NO: 9126 - protein, 7 aa, Homo sapiens
  Light chain CDR1
QSVSSNY

SEQ ID NO: 9127 - protein, 6 aa, Homo sapiens
  Light chain CDR1
QDITND

SEQ ID NO: 9128 - protein, 7 aa, Homo sapiens
  Light chain CDR1
QSVSSNY

SEQ ID NO: 9129 - protein, 7 aa, Homo sapiens
  Light chain CDR1
QSVSSSY

SEQ ID NO: 9130 - protein, 7 aa, Homo sapiens
  Light chain CDR1
QSVSSSY

SEQ ID NO: 9131 - protein, 7 aa, Homo sapiens
  Light chain CDR1
QSVSSSY

SEQ ID NO: 9132 - protein, 6 aa, Homo sapiens
  Light chain CDR1
QDISRL

SEQ ID NO: 9133 - protein, 6 aa, Homo sapiens
  Light chain CDR1
QGINNY

SEQ ID NO: 9134 - protein, 7 aa, Homo sapiens
  Light chain CDR1
QSVSSNY

SEQ ID NO: 9135 - protein, 6 aa, Homo sapiens
  Light chain CDR1
QDISSF

SEQ ID NO: 9136 - protein, 7 aa, Homo sapiens
  Light chain CDR1
QSVSSSY

SEQ ID NO: 9137 - protein, 7 aa, Homo sapiens
  Light chain CDR1
QSVSSNY

SEQ ID NO: 9138 - protein, 7 aa, Homo sapiens
  Light chain CDR1
QSVSSNY

SEQ ID NO: 9139 - protein, 7 aa, Homo sapiens
  Light chain CDR1
QSVSSSY

SEQ ID NO: 9140 - protein, 6 aa, Homo sapiens
  Light chain CDR1
QSIGSS

SEQ ID NO: 9141 - protein, 5 aa, Homo sapiens
  Light chain CDR1
QSTNY

SEQ ID NO: 9142 - protein, 6 aa, Homo sapiens
  Light chain CDR1
QSIGSS

SEQ ID NO: 9143 - protein, 7 aa, Homo sapiens
  Light chain CDR1
QSVSSSY

SEQ ID NO: 9144 - protein, 7 aa, Homo sapiens
  Light chain CDR1
QSISSSY

SEQ ID NO: 9145 - protein, 6 aa, Homo sapiens
  Light chain CDR1
QDITND

SEQ ID NO: 9146 - protein, 6 aa, Homo sapiens
  Light chain CDR1
QDITND

SEQ ID NO: 9147 - protein, 6 aa, Homo sapiens
  Light chain CDR1
QDISND

SEQ ID NO: 9148 - protein, 6 aa, Homo sapiens
  Light chain CDR1
QGINNY

SEQ ID NO: 9149 - protein, 7 aa, Homo sapiens
  Light chain CDR1
QSVSSSY

SEQ ID NO: 9150 - protein, 6 aa, Homo sapiens
  Light chain CDR1
QGISSF

SEQ ID NO: 9151 - protein, 6 aa, Homo sapiens
  Light chain CDR1
QDITND

SEQ ID NO: 9152 - protein, 6 aa, Homo sapiens
  Light chain CDR1
QGISSY

SEQ ID NO: 9153 - protein, 7 aa, Homo sapiens
  Light chain CDR1
QSVSSSY

SEQ ID NO: 9154 - protein, 6 aa, Homo sapiens
  Light chain CDR1
QGINNY

SEQ ID NO: 9155 - protein, 7 aa, Homo sapiens
  Light chain CDR1
QSISSSY

SEQ ID NO: 9156 - protein, 7 aa, Homo sapiens
  Light chain CDR1
QSVSSSY

SEQ ID NO: 9157 - protein, 7 aa, Homo sapiens
  Light chain CDR1
QSVSSSY

SEQ ID NO: 9158 - protein, 7 aa, Homo sapiens
  Light chain CDR1
QSVSSNY

SEQ ID NO: 9159 - protein, 7 aa, Homo sapiens
  Light chain CDR1
QSVSSSY

SEQ ID NO: 9160 - protein, 6 aa, Homo sapiens
  Light chain CDR1
QDITND

SEQ ID NO: 9161 - protein, 7 aa, Homo sapiens
  Light chain CDR1
QSVSSSY

SEQ ID NO: 9162 - protein, 6 aa, Homo sapiens
  Light chain CDR1
QGIGND

SEQ ID NO: 9163 - protein, 7 aa, Homo sapiens
  Light chain CDR1
QSVSSSY

SEQ ID NO: 9164 - protein, 7 aa, Homo sapiens
  Light chain CDR1
QSISSSY

SEQ ID NO: 9165 - protein, 7 aa, Homo sapiens
  Light chain CDR1
QSVSSNY

SEQ ID NO: 9166 - protein, 7 aa, Homo sapiens
  Light chain CDR1
QSVSSSY

SEQ ID NO: 9167 - protein, 7 aa, Homo sapiens
  Light chain CDR1
QSVSSSY

SEQ ID NO: 9168 - protein, 6 aa, Homo sapiens
  Light chain CDR1
QGISND

SEQ ID NO: 9169 - protein, 7 aa, Homo sapiens
  Light chain CDR1
QSVSSNY

SEQ ID NO: 9170 - protein, 7 aa, Homo sapiens
  Light chain CDR1
PSISSSY

SEQ ID NO: 9171 - protein, 7 aa, Homo sapiens
  Light chain CDR1
QSVSSSY

SEQ ID NO: 9172 - protein, 6 aa, Homo sapiens
  Light chain CDR1
QDITND

SEQ ID NO: 9173 - protein, 6 aa, Homo sapiens
  Light chain CDR1
QGISND

SEQ ID NO: 9174 - protein, 7 aa, Homo sapiens
  Light chain CDR1
QSVSSSY

SEQ ID NO: 9175 - protein, 6 aa, Homo sapiens
  Light chain CDR1
QNIGSS

SEQ ID NO: 9176 - protein, 6 aa, Homo sapiens
  Light chain CDR1
QDISND

SEQ ID NO: 9177 - protein, 6 aa, Homo sapiens
  Light chain CDR1
QDISRL

SEQ ID NO: 9178 - protein, 6 aa, Homo sapiens
  Light chain CDR1
QDISRL

SEQ ID NO: 9179 - protein, 7 aa, Homo sapiens
  Light chain CDR1
QSVSSSY

SEQ ID NO: 9180 - protein, 7 aa, Homo sapiens
  Light chain CDR1
QSVSSSY

SEQ ID NO: 9181 - protein, 7 aa, Homo sapiens
  Light chain CDR1
QSVSSNF

SEQ ID NO: 9182 - protein, 6 aa, Homo sapiens
  Light chain CDR1
QGISND

SEQ ID NO: 9183 - protein, 6 aa, Homo sapiens
  Light chain CDR1
QDISSF

SEQ ID NO: 9184 - protein, 6 aa, Homo sapiens
  Light chain CDR1
QDITND

SEQ ID NO: 9185 - protein, 7 aa, Homo sapiens
  Light chain CDR1
QSVSSSY

SEQ ID NO: 9186 - protein, 6 aa, Homo sapiens
  Light chain CDR1
QDISRL

SEQ ID NO: 9187 - protein, 6 aa, Homo sapiens
  Light chain CDR1
QGISSF

SEQ ID NO: 9188 - protein, 7 aa, Homo sapiens
  Light chain CDR1
QSVSSSY

SEQ ID NO: 9189 - protein, 7 aa, Homo sapiens
  Light chain CDR1
QSVSSSY

SEQ ID NO: 9190 - protein, 6 aa, Homo sapiens
  Light chain CDR1
QDITND

SEQ ID NO: 9191 - protein, 6 aa, Homo sapiens
  Light chain CDR1
QGISND

SEQ ID NO: 9192 - protein, 7 aa, Homo sapiens
  Light chain CDR1
QSVSSSY

SEQ ID NO: 9193 - protein, 7 aa, Homo sapiens
  Light chain CDR1
QSVSSSY

SEQ ID NO: 9194 - protein, 6 aa, Homo sapiens
  Light chain CDR1
QGINND

SEQ ID NO: 9195 - protein, 7 aa, Homo sapiens
  Light chain CDR1
QSVSSSY

SEQ ID NO: 9196 - protein, 6 aa, Homo sapiens
  Light chain CDR1
QDISRL

SEQ ID NO: 9197 - protein, 7 aa, Homo sapiens
  Light chain CDR1
QSVSSSY

SEQ ID NO: 9198 - protein, 7 aa, Homo sapiens
  Light chain CDR1
QSVSSSY

SEQ ID NO: 9199 - protein, 7 aa, Homo sapiens
  Light chain CDR1
QSVSSNY

SEQ ID NO: 9200 - protein, 7 aa, Homo sapiens
  Light chain CDR1
QSVSSSY

SEQ ID NO: 9201 - protein, 6 aa, Homo sapiens
  Light chain CDR1
QDITND

SEQ ID NO: 9202 - protein, 7 aa, Homo sapiens
  Light chain CDR1
QSVSSSY

SEQ ID NO: 9203 - protein, 7 aa, Homo sapiens
  Light chain CDR1
QSVSSSY

SEQ ID NO: 9204 - protein, 7 aa, Homo sapiens
  Light chain CDR1
QSVSSNF

SEQ ID NO: 9205 - protein, 6 aa, Homo sapiens
  Light chain CDR1
QGISND

SEQ ID NO: 9206 - protein, 6 aa, Homo sapiens
  Light chain CDR1
QGISND

SEQ ID NO: 9207 - protein, 6 aa, Homo sapiens
  Light chain CDR1
QDISRL

SEQ ID NO: 9208 - protein, 7 aa, Homo sapiens
  Light chain CDR1
QSVSGSY

SEQ ID NO: 9209 - protein, 6 aa, Homo sapiens
  Light chain CDR1
QGISSY

SEQ ID NO: 9210 - protein, 7 aa, Homo sapiens
  Light chain CDR1
QSVSSSY

SEQ ID NO: 9211 - protein, 7 aa, Homo sapiens
  Light chain CDR1
QSVSSSY

SEQ ID NO: 9212 - protein, 7 aa, Homo sapiens
  Light chain CDR1
QSVSSSY

SEQ ID NO: 9213 - protein, 6 aa, Homo sapiens
  Light chain CDR1
QGISND

SEQ ID NO: 9214 - protein, 6 aa, Homo sapiens
  Light chain CDR1
QGISND

SEQ ID NO: 9215 - protein, 6 aa, Homo sapiens
  Light chain CDR1
QGISND

SEQ ID NO: 9216 - protein, 6 aa, Homo sapiens
  Light chain CDR1
QGISND

SEQ ID NO: 9217 - protein, 7 aa, Homo sapiens
  Light chain CDR1
QSVSSSY

SEQ ID NO: 9218 - protein, 6 aa, Homo sapiens
  Light chain CDR1
QGISND

SEQ ID NO: 9219 - protein, 6 aa, Homo sapiens
  Light chain CDR1
QGISND

SEQ ID NO: 9220 - protein, 6 aa, Homo sapiens
  Light chain CDR1
QGISND

SEQ ID NO: 9221 - protein, 6 aa, Homo sapiens
  Light chain CDR1
QGISND

SEQ ID NO: 9222 - protein, 6 aa, Homo sapiens
  Light chain CDR1
QDISND

SEQ ID NO: 9223 - protein, 6 aa, Homo sapiens
  Light chain CDR1
QGISSY

SEQ ID NO: 9224 - protein, 6 aa, Homo sapiens
  Light chain CDR1
QGISND

SEQ ID NO: 9225 - protein, 7 aa, Homo sapiens
  Light chain CDR1
QSVSSSY

SEQ ID NO: 9226 - protein, 6 aa, Homo sapiens
  Light chain CDR1
QGISND

SEQ ID NO: 9227 - protein, 7 aa, Homo sapiens
  Light chain CDR1
QSVSSSY

SEQ ID NO: 9228 - protein, 7 aa, Homo sapiens
  Light chain CDR1
QSVSSSY

SEQ ID NO: 9229 - protein, 6 aa, Homo sapiens
  Light chain CDR1
QGISND

SEQ ID NO: 9230 - protein, 7 aa, Homo sapiens
  Light chain CDR1
QSVSSSY

SEQ ID NO: 9231 - protein, 7 aa, Homo sapiens
  Light chain CDR1
QSVSSSY

SEQ ID NO: 9232 - protein, 7 aa, Homo sapiens
  Light chain CDR1
QSVSSSY

SEQ ID NO: 9233 - protein, 7 aa, Homo sapiens
  Light chain CDR1
QSGSSSY

SEQ ID NO: 9234 - protein, 7 aa, Homo sapiens
  Light chain CDR1
QSVSSSY

SEQ ID NO: 9235 - protein, 7 aa, Homo sapiens
  Light chain CDR1
QSGSSSY

SEQ ID NO: 9236 - protein, 7 aa, Homo sapiens
  Light chain CDR1
QSVSSSY

SEQ ID NO: 9237 - protein, 11 aa, Homo sapiens
  Light chain CDR1
QSLLHSNGYNY

SEQ ID NO: 9238 - protein, 7 aa, Homo sapiens
  Light chain CDR1
QSDSSSY

SEQ ID NO: 9239 - protein, 6 aa, Homo sapiens
  Light chain CDR1
QSISSY

SEQ ID NO: 9240 - protein, 11 aa, Homo sapiens
  Light chain CDR1
QSLLHSNGYNY

SEQ ID NO: 9241 - protein, 6 aa, Homo sapiens
  Light chain CDR1
QSIGSS

SEQ ID NO: 9242 - protein, 7 aa, Homo sapiens
  Light chain CDR1
QSVSSSY

SEQ ID NO: 9243 - protein, 6 aa, Homo sapiens
  Light chain CDR1
QGISNY

SEQ ID NO: 9244 - protein, 7 aa, Homo sapiens
  Light chain CDR1
QSVSSSY

SEQ ID NO: 9245 - protein, 7 aa, Homo sapiens
  Light chain CDR1
QSVSSTY

SEQ ID NO: 9246 - protein, 7 aa, Homo sapiens
  Light chain CDR1
QSVSSSY

SEQ ID NO: 9247 - protein, 7 aa, Homo sapiens
  Light chain CDR1
QSGSSSY

SEQ ID NO: 9248 - protein, 7 aa, Homo sapiens
  Light chain CDR1
QSVSSSY

SEQ ID NO: 9249 - protein, 7 aa, Homo sapiens
  Light chain CDR1
QSGSSSY

SEQ ID NO: 9250 - protein, 7 aa, Homo sapiens
  Light chain CDR1
QSVSSSY

SEQ ID NO: 9251 - protein, 7 aa, Homo sapiens
  Light chain CDR1
QSVSSSY

SEQ ID NO: 9252 - protein, 7 aa, Homo sapiens
  Light chain CDR1
QSVSSSY

SEQ ID NO: 9253 - protein, 7 aa, Homo sapiens
  Light chain CDR1
QSVSSSY

SEQ ID NO: 9254 - protein, 7 aa, Homo sapiens
  Light chain CDR1
QSGSSSY

SEQ ID NO: 9255 - protein, 7 aa, Homo sapiens
  Light chain CDR1
QSVSSSY

SEQ ID NO: 9256 - protein, 7 aa, Homo sapiens
  Light chain CDR1
QSVSSSY

SEQ ID NO: 9257 - protein, 7 aa, Homo sapiens
  Light chain CDR1
QSGSSSY

SEQ ID NO: 9258 - protein, 7 aa, Homo sapiens
  Light chain CDR1
QSVSSSY

SEQ ID NO: 9259 - protein, 7 aa, Homo sapiens
  Light chain CDR1
QSVSSSY

SEQ ID NO: 9260 - protein, 7 aa, Homo sapiens
  Light chain CDR1
QSVSSSY

SEQ ID NO: 9261 - protein, 7 aa, Homo sapiens
  Light chain CDR1
QSGSSSY

SEQ ID NO: 9262 - protein, 7 aa, Homo sapiens
  Light chain CDR1
QSVSSTY

SEQ ID NO: 9263 - protein, 7 aa, Homo sapiens
  Light chain CDR1
QSGSSSY

SEQ ID NO: 9264 - protein, 11 aa, Homo sapiens
  Light chain CDR1
QSLLHSNGYNY

SEQ ID NO: 9265 - protein, 7 aa, Homo sapiens
  Light chain CDR1
QSVSSSY

SEQ ID NO: 9266 - protein, 7 aa, Homo sapiens
  Light chain CDR1
QSVSSSY

SEQ ID NO: 9267 - protein, 7 aa, Homo sapiens
  Light chain CDR1
QSVSSSY

SEQ ID NO: 9268 - protein, 7 aa, Homo sapiens
  Light chain CDR1
QSVSSSY

SEQ ID NO: 9269 - protein, 7 aa, Homo sapiens
  Light chain CDR1
QSVSSSY

SEQ ID NO: 9270 - protein, 7 aa, Homo sapiens
  Light chain CDR1
QTISSSY

SEQ ID NO: 9271 - protein, 7 aa, Homo sapiens
  Light chain CDR1
QSVSSSY

SEQ ID NO: 9272 - protein, 7 aa, Homo sapiens
  Light chain CDR1
QSVSSSY

SEQ ID NO: 9273 - protein, 5 aa, Homo sapiens
  Light chain CDR1
QSVSY

SEQ ID NO: 9274 - protein, 7 aa, Homo sapiens
  Light chain CDR1
QSVSSSY

SEQ ID NO: 9275 - protein, 5 aa, Homo sapiens
  Light chain CDR1
QSVSY

SEQ ID NO: 9276 - protein, 7 aa, Homo sapiens
  Light chain CDR1
QSVSSSY

SEQ ID NO: 9277 - protein, 7 aa, Homo sapiens
  Light chain CDR1
QSVSSSY

SEQ ID NO: 9278 - protein, 7 aa, Homo sapiens
  Light chain CDR1
QSVSSSY

SEQ ID NO: 9279 - protein, 7 aa, Homo sapiens
  Light chain CDR1
QTISSSY

SEQ ID NO: 9280 - protein, 7 aa, Homo sapiens
  Light chain CDR1
QSVSSSY

SEQ ID NO: 9281 - protein, 7 aa, Homo sapiens
  Light chain CDR1
QSVSSSY

SEQ ID NO: 9282 - protein, 7 aa, Homo sapiens
  Light chain CDR1
QSVSSSY

SEQ ID NO: 9283 - protein, 7 aa, Homo sapiens
  Light chain CDR1
QSVSSSY

SEQ ID NO: 9284 - protein, 7 aa, Homo sapiens
  Light chain CDR1
QSVSSSY

SEQ ID NO: 9285 - protein, 7 aa, Homo sapiens
  Light chain CDR1
QSVSSSY

SEQ ID NO: 9286 - protein, 7 aa, Homo sapiens
  Light chain CDR1
QSVSSSY

SEQ ID NO: 9287 - protein, 7 aa, Homo sapiens
  Light chain CDR1
QSVSSSY

SEQ ID NO: 9288 - protein, 7 aa, Homo sapiens
  Light chain CDR1
QSVSSSY

SEQ ID NO: 9289 - protein, 7 aa, Homo sapiens
  Light chain CDR1
QSVSSSY

SEQ ID NO: 9290 - protein, 7 aa, Homo sapiens
  Light chain CDR1
QSVSSSY

SEQ ID NO: 9291 - protein, 7 aa, Homo sapiens
  Light chain CDR1
QSVSSSY

SEQ ID NO: 9292 - protein, 7 aa, Homo sapiens
  Light chain CDR1
QSVSSSY

SEQ ID NO: 9293 - protein, 7 aa, Homo sapiens
  Light chain CDR1
QSVSSSY

SEQ ID NO: 9294 - protein, 7 aa, Homo sapiens
  Light chain CDR1
QSVSSTY

SEQ ID NO: 9295 - protein, 7 aa, Homo sapiens
  Light chain CDR1
QSVSSSY

SEQ ID NO: 9296 - protein, 6 aa, Homo sapiens
  Light chain CDR1
QSISSY

SEQ ID NO: 9297 - protein, 7 aa, Homo sapiens
  Light chain CDR1
QSVSSSY

SEQ ID NO: 9298 - protein, 6 aa, Homo sapiens
  Light chain CDR1
QGISNY

SEQ ID NO: 9299 - protein, 7 aa, Homo sapiens
  Light chain CDR1
QSVSSSY

SEQ ID NO: 9300 - protein, 7 aa, Homo sapiens
  Light chain CDR1
QSGSSSY

SEQ ID NO: 9301 - protein, 7 aa, Homo sapiens
  Light chain CDR1
QSVSSSY

SEQ ID NO: 9302 - protein, 7 aa, Homo sapiens
  Light chain CDR1
QSVSSSY

SEQ ID NO: 9303 - protein, 7 aa, Homo sapiens
  Light chain CDR1
QSVSSSY

SEQ ID NO: 9304 - protein, 6 aa, Homo sapiens
  Light chain CDR1
QSISSY

SEQ ID NO: 9305 - protein, 7 aa, Homo sapiens
  Light chain CDR1
QTISSSY

SEQ ID NO: 9306 - protein, 5 aa, Homo sapiens
  Light chain CDR1
QSVSY

SEQ ID NO: 9307 - protein, 12 aa, Homo sapiens
  Light chain CDR1
QSVLYRSNNKNY

SEQ ID NO: 9308 - protein, 7 aa, Homo sapiens
  Light chain CDR1
QSVSSSY

SEQ ID NO: 9309 - protein, 12 aa, Homo sapiens
  Light chain CDR1
QSVLYSSNNKNY

SEQ ID NO: 9310 - protein, 6 aa, Homo sapiens
  Light chain CDR1
QSIGSS

SEQ ID NO: 9311 - protein, 11 aa, Homo sapiens
  Light chain CDR1
QSLLHSNGLNY

SEQ ID NO: 9312 - protein, 11 aa, Homo sapiens
  Light chain CDR1
QSLLHSNGYNY

SEQ ID NO: 9313 - protein, 7 aa, Homo sapiens
  Light chain CDR1
QSVSSSY

SEQ ID NO: 9314 - protein, 6 aa, Homo sapiens
  Light chain CDR1
QGISNY

SEQ ID NO: 9315 - protein, 7 aa, Homo sapiens
  Light chain CDR1
QSVSSSY

SEQ ID NO: 9316 - protein, 7 aa, Homo sapiens
  Light chain CDR1
QSVSSSY

SEQ ID NO: 9317 - protein, 7 aa, Homo sapiens
  Light chain CDR1
QSVSSSY

SEQ ID NO: 9318 - protein, 7 aa, Homo sapiens
  Light chain CDR1
QSVSSSY

SEQ ID NO: 9319 - protein, 7 aa, Homo sapiens
  Light chain CDR1
QSVSSSY

SEQ ID NO: 9320 - protein, 7 aa, Homo sapiens
  Light chain CDR1
QSVSSNY

SEQ ID NO: 9321 - protein, 7 aa, Homo sapiens
  Light chain CDR1
QSVSSSY

SEQ ID NO: 9322 - protein, 7 aa, Homo sapiens
  Light chain CDR1
QSVSSSY

SEQ ID NO: 9323 - protein, 7 aa, Homo sapiens
  Light chain CDR1
QSFSSSY

SEQ ID NO: 9324 - protein, 6 aa, Homo sapiens
  Light chain CDR1
QSISSY

SEQ ID NO: 9325 - protein, 7 aa, Homo sapiens
  Light chain CDR1
QSVSSSY

SEQ ID NO: 9326 - protein, 7 aa, Homo sapiens
  Light chain CDR1
QSVSSSY

SEQ ID NO: 9327 - protein, 7 aa, Homo sapiens
  Light chain CDR1
QSVSSSY

SEQ ID NO: 9328 - protein, 7 aa, Homo sapiens
  Light chain CDR1
QSVSSSY

SEQ ID NO: 9329 - protein, 6 aa, Homo sapiens
  Light chain CDR1
QGIRYD

SEQ ID NO: 9330 - protein, 7 aa, Homo sapiens
  Light chain CDR1
QSVSSSY

SEQ ID NO: 9331 - protein, 7 aa, Homo sapiens
  Light chain CDR1
QTISSSY

SEQ ID NO: 9332 - protein, 7 aa, Homo sapiens
  Light chain CDR1
QSVSSSY

SEQ ID NO: 9333 - protein, 7 aa, Homo sapiens
  Light chain CDR1
QTISSSY

SEQ ID NO: 9334 - protein, 7 aa, Homo sapiens
  Light chain CDR1
QSVSSSY

SEQ ID NO: 9335 - protein, 7 aa, Homo sapiens
  Light chain CDR1
QTVSSIY

SEQ ID NO: 9336 - protein, 7 aa, Homo sapiens
  Light chain CDR1
QSVSSSY

SEQ ID NO: 9337 - protein, 7 aa, Homo sapiens
  Light chain CDR1
QSVSSSY

SEQ ID NO: 9338 - protein, 7 aa, Homo sapiens
  Light chain CDR1
QSVSSSY

SEQ ID NO: 9339 - protein, 7 aa, Homo sapiens
  Light chain CDR1
QSVSSSY

SEQ ID NO: 9340 - protein, 7 aa, Homo sapiens
  Light chain CDR1
QSVSSSY

SEQ ID NO: 9341 - protein, 7 aa, Homo sapiens
  Light chain CDR1
QSVSSSY

SEQ ID NO: 9342 - protein, 7 aa, Homo sapiens
  Light chain CDR1
QSVSSSC

SEQ ID NO: 9343 - protein, 7 aa, Homo sapiens
  Light chain CDR1
QSVSSSC

SEQ ID NO: 9344 - protein, 7 aa, Homo sapiens
  Light chain CDR1
QSVSSSY

SEQ ID NO: 9345 - protein, 7 aa, Homo sapiens
  Light chain CDR1
QSVSSSY

SEQ ID NO: 9346 - protein, 7 aa, Homo sapiens
  Light chain CDR1
QSVSSSY

SEQ ID NO: 9347 - protein, 7 aa, Homo sapiens
  Light chain CDR1
QSVSSSY

SEQ ID NO: 9348 - protein, 7 aa, Homo sapiens
  Light chain CDR1
QSVSSSY

SEQ ID NO: 9349 - protein, 5 aa, Homo sapiens
  Light chain CDR1
QSVSY

SEQ ID NO: 9350 - protein, 7 aa, Homo sapiens
  Light chain CDR1
QSVSSSY

SEQ ID NO: 9351 - protein, 7 aa, Homo sapiens
  Light chain CDR1
QSVSSSY

SEQ ID NO: 9352 - protein, 7 aa, Homo sapiens
  Light chain CDR1
QSVSSSY

SEQ ID NO: 9353 - protein, 11 aa, Homo sapiens
  Light chain CDR1
QSLLHSNGYNY

SEQ ID NO: 9354 - protein, 7 aa, Homo sapiens
  Light chain CDR1
QSVSSSY

SEQ ID NO: 9355 - protein, 7 aa, Homo sapiens
  Light chain CDR1
QSVSSSC

SEQ ID NO: 9356 - protein, 7 aa, Homo sapiens
  Light chain CDR1
QSVSSSY

SEQ ID NO: 9357 - protein, 7 aa, Homo sapiens
  Light chain CDR1
QSVSSSC

SEQ ID NO: 9358 - protein, 7 aa, Homo sapiens
  Light chain CDR1
QSVSSSY

SEQ ID NO: 9359 - protein, 7 aa, Homo sapiens
  Light chain CDR1
QSVSSSC

SEQ ID NO: 9360 - protein, 7 aa, Homo sapiens
  Light chain CDR1
QSVSSSC

SEQ ID NO: 9361 - protein, 7 aa, Homo sapiens
  Light chain CDR1
QSVSSSY

SEQ ID NO: 9362 - protein, 7 aa, Homo sapiens
  Light chain CDR1
QSVSSSC

SEQ ID NO: 9363 - protein, 7 aa, Homo sapiens
  Light chain CDR1
QSVSSSY

SEQ ID NO: 9364 - protein, 7 aa, Homo sapiens
  Light chain CDR1
QSVSSSC

SEQ ID NO: 9365 - protein, 7 aa, Homo sapiens
  Light chain CDR1
QSVSSSC

SEQ ID NO: 9366 - protein, 7 aa, Homo sapiens
  Light chain CDR1
QSVSSSY

SEQ ID NO: 9367 - protein, 7 aa, Homo sapiens
  Light chain CDR1
QSVSSSY

SEQ ID NO: 9368 - protein, 7 aa, Homo sapiens
  Light chain CDR1
QSVSSSY

SEQ ID NO: 9369 - protein, 7 aa, Homo sapiens
  Light chain CDR1
QSVSSSY

SEQ ID NO: 9370 - protein, 6 aa, Homo sapiens
  Light chain CDR1
QSIGSS

SEQ ID NO: 9371 - protein, 7 aa, Homo sapiens
  Light chain CDR1
QSVSSSY

SEQ ID NO: 9372 - protein, 6 aa, Homo sapiens
  Light chain CDR1
QAIRND

SEQ ID NO: 9373 - protein, 7 aa, Homo sapiens
  Light chain CDR1
QSVSSSY

SEQ ID NO: 9374 - protein, 7 aa, Homo sapiens
  Light chain CDR1
QSVSSSY

SEQ ID NO: 9375 - protein, 7 aa, Homo sapiens
  Light chain CDR1
QSVSSSY

SEQ ID NO: 9376 - protein, 7 aa, Homo sapiens
  Light chain CDR1
QSVSSSY

SEQ ID NO: 9377 - protein, 6 aa, Homo sapiens
  Light chain CDR1
QAIRND

SEQ ID NO: 9378 - protein, 7 aa, Homo sapiens
  Light chain CDR1
QSVSSSY

SEQ ID NO: 9379 - protein, 7 aa, Homo sapiens
  Light chain CDR1
QSVSSSY

SEQ ID NO: 9380 - protein, 7 aa, Homo sapiens
  Light chain CDR1
QSVSSNY

SEQ ID NO: 9381 - protein, 7 aa, Homo sapiens
  Light chain CDR1
QSVSSSY

SEQ ID NO: 9382 - protein, 7 aa, Homo sapiens
  Light chain CDR1
QSVSSSY

SEQ ID NO: 9383 - protein, 7 aa, Homo sapiens
  Light chain CDR1
QSVSSSY

SEQ ID NO: 9384 - protein, 6 aa, Homo sapiens
  Light chain CDR1
QSISSY

SEQ ID NO: 9385 - protein, 11 aa, Homo sapiens
  Light chain CDR1
QSLVYSDGNTY

SEQ ID NO: 9386 - protein, 7 aa, Homo sapiens
  Light chain CDR1
QSVSSSY

SEQ ID NO: 9387 - protein, 7 aa, Homo sapiens
  Light chain CDR1
QSVSSSY

SEQ ID NO: 9388 - protein, 11 aa, Homo sapiens
  Light chain CDR1
QSLLHSNGYNY

SEQ ID NO: 9389 - protein, 7 aa, Homo sapiens
  Light chain CDR1
QSVSSSY

SEQ ID NO: 9390 - protein, 6 aa, Homo sapiens
  Light chain CDR1
QSISSY

SEQ ID NO: 9391 - protein, 7 aa, Homo sapiens
  Light chain CDR1
QSVSSSY

SEQ ID NO: 9392 - protein, 6 aa, Homo sapiens
  Light chain CDR1
QGISNY

SEQ ID NO: 9393 - protein, 6 aa, Homo sapiens
  Light chain CDR1
QSISSY

SEQ ID NO: 9394 - protein, 7 aa, Homo sapiens
  Light chain CDR1
QSVSSNF

SEQ ID NO: 9395 - protein, 6 aa, Homo sapiens
  Light chain CDR1
QGISNY

SEQ ID NO: 9396 - protein, 6 aa, Homo sapiens
  Light chain CDR1
QSISSY

SEQ ID NO: 9397 - protein, 7 aa, Homo sapiens
  Light chain CDR1
QSVSSSY

SEQ ID NO: 9398 - protein, 6 aa, Homo sapiens
  Light chain CDR1
QSISSY

SEQ ID NO: 9399 - protein, 7 aa, Homo sapiens
  Light chain CDR1
QSVSSSY

SEQ ID NO: 9400 - protein, 7 aa, Homo sapiens
  Light chain CDR1
QSVSSSY

SEQ ID NO: 9401 - protein, 6 aa, Homo sapiens
  Light chain CDR1
QGISNY

SEQ ID NO: 9402 - protein, 7 aa, Homo sapiens
  Light chain CDR1
QSVSSSY

SEQ ID NO: 9403 - protein, 7 aa, Homo sapiens
  Light chain CDR1
QSVSSSY

SEQ ID NO: 9404 - protein, 7 aa, Homo sapiens
  Light chain CDR1
QSGSSSY

SEQ ID NO: 9405 - protein, 7 aa, Homo sapiens
  Light chain CDR1
QSGSSSY

SEQ ID NO: 9406 - protein, 7 aa, Homo sapiens
  Light chain CDR1
QSVSSSY

SEQ ID NO: 9407 - protein, 7 aa, Homo sapiens
  Light chain CDR1
QSVSSSY

SEQ ID NO: 9408 - protein, 6 aa, Homo sapiens
  Light chain CDR1
QGISSY

SEQ ID NO: 9409 - protein, 7 aa, Homo sapiens
  Light chain CDR1
QSVSSSY

SEQ ID NO: 9410 - protein, 6 aa, Homo sapiens
  Light chain CDR1
QSIGSS

SEQ ID NO: 9411 - protein, 6 aa, Homo sapiens
  Light chain CDR1
QSISSY

SEQ ID NO: 9412 - protein, 6 aa, Homo sapiens
  Light chain CDR1
QGISNY

SEQ ID NO: 9413 - protein, 7 aa, Homo sapiens
  Light chain CDR1
QSVSSSY

SEQ ID NO: 9414 - protein, 7 aa, Homo sapiens
  Light chain CDR1
QSVSSSY

SEQ ID NO: 9415 - protein, 6 aa, Homo sapiens
  Light chain CDR1
QGISNY

SEQ ID NO: 9416 - protein, 7 aa, Homo sapiens
  Light chain CDR1
QSFSSSY

SEQ ID NO: 9417 - protein, 7 aa, Homo sapiens
  Light chain CDR1
QSVSSSY

SEQ ID NO: 9418 - protein, 7 aa, Homo sapiens
  Light chain CDR1
QSVSSSY

SEQ ID NO: 9419 - protein, 7 aa, Homo sapiens
  Light chain CDR1
QSVSSSY

SEQ ID NO: 9420 - protein, 7 aa, Homo sapiens
  Light chain CDR1
QSVSSSY

SEQ ID NO: 9421 - protein, 7 aa, Homo sapiens
  Light chain CDR1
QSVSSSY

SEQ ID NO: 9422 - protein, 7 aa, Homo sapiens
  Light chain CDR1
QSVFSSY

SEQ ID NO: 9423 - protein, 6 aa, Homo sapiens
  Light chain CDR1
QSISSY

SEQ ID NO: 9424 - protein, 7 aa, Homo sapiens
  Light chain CDR1
QSVSSSY

SEQ ID NO: 9425 - protein, 7 aa, Homo sapiens
  Light chain CDR1
QSVSSSY

SEQ ID NO: 9426 - protein, 7 aa, Homo sapiens
  Light chain CDR1
QSVSSSY

SEQ ID NO: 9427 - protein, 7 aa, Homo sapiens
  Light chain CDR1
QSVSSSY

SEQ ID NO: 9428 - protein, 7 aa, Homo sapiens
  Light chain CDR1
QSVSSSY

SEQ ID NO: 9429 - protein, 7 aa, Homo sapiens
  Light chain CDR1
QSVSSSY

SEQ ID NO: 9430 - protein, 6 aa, Homo sapiens
  Light chain CDR1
QGISNY

SEQ ID NO: 9431 - protein, 7 aa, Homo sapiens
  Light chain CDR1
QSVSSSY

SEQ ID NO: 9432 - protein, 7 aa, Homo sapiens
  Light chain CDR1
QSVSSSY

SEQ ID NO: 9433 - protein, 7 aa, Homo sapiens
  Light chain CDR1
QSVSSSY

SEQ ID NO: 9434 - protein, 6 aa, Homo sapiens
  Light chain CDR1
QSVSSY

SEQ ID NO: 9435 - protein, 7 aa, Homo sapiens
  Light chain CDR1
QSVSSSY

SEQ ID NO: 9436 - protein, 7 aa, Homo sapiens
  Light chain CDR1
QSVSSSY

SEQ ID NO: 9437 - protein, 7 aa, Homo sapiens
  Light chain CDR1
QSVSSSY

SEQ ID NO: 9438 - protein, 7 aa, Homo sapiens
  Light chain CDR1
QSVSSSY

SEQ ID NO: 9439 - protein, 7 aa, Homo sapiens
  Light chain CDR1
QSVSSSY

SEQ ID NO: 9440 - protein, 7 aa, Homo sapiens
  Light chain CDR1
QSGSSSY

SEQ ID NO: 9441 - protein, 5 aa, Homo sapiens
  Light chain CDR1
QSVSY

SEQ ID NO: 9442 - protein, 7 aa, Homo sapiens
  Light chain CDR1
QSVSSSY

SEQ ID NO: 9443 - protein, 7 aa, Homo sapiens
  Light chain CDR1
QSVSSSY

SEQ ID NO: 9444 - protein, 5 aa, Homo sapiens
  Light chain CDR1
QSVSY

SEQ ID NO: 9445 - protein, 7 aa, Homo sapiens
  Light chain CDR1
QSVSSSY

SEQ ID NO: 9446 - protein, 6 aa, Homo sapiens
  Light chain CDR1
QGISNY

SEQ ID NO: 9447 - protein, 7 aa, Homo sapiens
  Light chain CDR1
QSVSSSY

SEQ ID NO: 9448 - protein, 7 aa, Homo sapiens
  Light chain CDR1
QSVSSSY

SEQ ID NO: 9449 - protein, 11 aa, Homo sapiens
  Light chain CDR1
QSLLHSNGYNY

SEQ ID NO: 9450 - protein, 7 aa, Homo sapiens
  Light chain CDR1
QSVSSSY

SEQ ID NO: 9451 - protein, 7 aa, Homo sapiens
  Light chain CDR1
QSVSSSY

SEQ ID NO: 9452 - protein, 7 aa, Homo sapiens
  Light chain CDR1
QSVSSSY

SEQ ID NO: 9453 - protein, 7 aa, Homo sapiens
  Light chain CDR1
QSVSSSY

SEQ ID NO: 9454 - protein, 6 aa, Homo sapiens
  Light chain CDR1
QGISNY

SEQ ID NO: 9455 - protein, 7 aa, Homo sapiens
  Light chain CDR1
QSVSSSY

SEQ ID NO: 9456 - protein, 5 aa, Homo sapiens
  Light chain CDR1
QSVSY

SEQ ID NO: 9457 - protein, 5 aa, Homo sapiens
  Light chain CDR1
QSVSY

SEQ ID NO: 9458 - protein, 5 aa, Homo sapiens
  Light chain CDR1
QSVSY

SEQ ID NO: 9459 - protein, 5 aa, Homo sapiens
  Light chain CDR1
QSVSY

SEQ ID NO: 9460 - protein, 7 aa, Homo sapiens
  Light chain CDR1
QSVSSSY

SEQ ID NO: 9461 - protein, 7 aa, Homo sapiens
  Light chain CDR1
QSVSSSY

SEQ ID NO: 9462 - protein, 5 aa, Homo sapiens
  Light chain CDR1
QSVSY

SEQ ID NO: 9463 - protein, 5 aa, Homo sapiens
  Light chain CDR1
QSVSY

SEQ ID NO: 9464 - protein, 7 aa, Homo sapiens
  Light chain CDR1
QSVSSSY

SEQ ID NO: 9465 - protein, 6 aa, Homo sapiens
  Light chain CDR1
QSVSSY

SEQ ID NO: 9466 - protein, 5 aa, Homo sapiens
  Light chain CDR1
QSVSY

SEQ ID NO: 9467 - protein, 7 aa, Homo sapiens
  Light chain CDR1
QSVSSSY

SEQ ID NO: 9468 - protein, 5 aa, Homo sapiens
  Light chain CDR1
QSVSY

SEQ ID NO: 9469 - protein, 6 aa, Homo sapiens
  Light chain CDR1
QRISSY

SEQ ID NO: 9470 - protein, 5 aa, Homo sapiens
  Light chain CDR1
QSVSY

SEQ ID NO: 9471 - protein, 7 aa, Homo sapiens
  Light chain CDR1
QSVSSSY

SEQ ID NO: 9472 - protein, 7 aa, Homo sapiens
  Light chain CDR1
QSVSSSY

SEQ ID NO: 9473 - protein, 7 aa, Homo sapiens
  Light chain CDR1
QSVNNRY

SEQ ID NO: 9474 - protein, 5 aa, Homo sapiens
  Light chain CDR1
QSVSY

SEQ ID NO: 9475 - protein, 5 aa, Homo sapiens
  Light chain CDR1
QSVSY

SEQ ID NO: 9476 - protein, 7 aa, Homo sapiens
  Light chain CDR1
QSVSSSY

SEQ ID NO: 9477 - protein, 7 aa, Homo sapiens
  Light chain CDR1
QSVSSSY

SEQ ID NO: 9478 - protein, 7 aa, Homo sapiens
  Light chain CDR1
QSVSSSY

SEQ ID NO: 9479 - protein, 7 aa, Homo sapiens
  Light chain CDR1
QSVSSSY

SEQ ID NO: 9480 - protein, 7 aa, Homo sapiens
  Light chain CDR1
QSVSSSY

SEQ ID NO: 9481 - protein, 7 aa, Homo sapiens
  Light chain CDR1
QSVSSSY

SEQ ID NO: 9482 - protein, 5 aa, Homo sapiens
  Light chain CDR1
QSVSY

SEQ ID NO: 9483 - protein, 7 aa, Homo sapiens
  Light chain CDR1
QSVSSSY

SEQ ID NO: 9484 - protein, 7 aa, Homo sapiens
  Light chain CDR1
QSVGSNY

SEQ ID NO: 9485 - protein, 7 aa, Homo sapiens
  Light chain CDR1
QSVSSSY

SEQ ID NO: 9486 - protein, 7 aa, Homo sapiens
  Light chain CDR1
QSVSSSY

SEQ ID NO: 9487 - protein, 7 aa, Homo sapiens
  Light chain CDR1
QSVSSSY

SEQ ID NO: 9488 - protein, 3 aa, Homo sapiens
  Light chain CDR2
ASS

SEQ ID NO: 9489 - protein, 3 aa, Homo sapiens
  Light chain CDR2
AAS

SEQ ID NO: 9490 - protein, 3 aa, Homo sapiens
  Light chain CDR2
GAS

SEQ ID NO: 9491 - protein, 3 aa, Homo sapiens
  Light chain CDR2
AAS

SEQ ID NO: 9492 - protein, 3 aa, Homo sapiens
  Light chain CDR2
AAS

SEQ ID NO: 9493 - protein, 3 aa, Homo sapiens
  Light chain CDR2
AAS

SEQ ID NO: 9494 - protein, 3 aa, Homo sapiens
  Light chain CDR2
AAS

SEQ ID NO: 9495 - protein, 3 aa, Homo sapiens
  Light chain CDR2
GAS

SEQ ID NO: 9496 - protein, 3 aa, Homo sapiens
  Light chain CDR2
AAS

SEQ ID NO: 9497 - protein, 3 aa, Homo sapiens
  Light chain CDR2
AAS

SEQ ID NO: 9498 - protein, 3 aa, Homo sapiens
  Light chain CDR2
AAS

SEQ ID NO: 9499 - protein, 3 aa, Homo sapiens
  Light chain CDR2
AAS

SEQ ID NO: 9500 - protein, 3 aa, Homo sapiens
  Light chain CDR2
GTS

SEQ ID NO: 9501 - protein, 3 aa, Homo sapiens
  Light chain CDR2
GAS

SEQ ID NO: 9502 - protein, 3 aa, Homo sapiens
  Light chain CDR2
AAS

SEQ ID NO: 9503 - protein, 3 aa, Homo sapiens
  Light chain CDR2
AAS

SEQ ID NO: 9504 - protein, 3 aa, Homo sapiens
  Light chain CDR2
AAS

SEQ ID NO: 9505 - protein, 3 aa, Homo sapiens
  Light chain CDR2
AAS

SEQ ID NO: 9506 - protein, 3 aa, Homo sapiens
  Light chain CDR2
TAS

SEQ ID NO: 9507 - protein, 3 aa, Homo sapiens
  Light chain CDR2
ASS

SEQ ID NO: 9508 - protein, 3 aa, Homo sapiens
  Light chain CDR2
ASS

SEQ ID NO: 9509 - protein, 3 aa, Homo sapiens
  Light chain CDR2
AAS

SEQ ID NO: 9510 - protein, 3 aa, Homo sapiens
  Light chain CDR2
AAS

SEQ ID NO: 9511 - protein, 3 aa, Homo sapiens
  Light chain CDR2
ASS

SEQ ID NO: 9512 - protein, 3 aa, Homo sapiens
  Light chain CDR2
AAS

SEQ ID NO: 9513 - protein, 3 aa, Homo sapiens
  Light chain CDR2
ASS

SEQ ID NO: 9514 - protein, 3 aa, Homo sapiens
  Light chain CDR2
AAS

SEQ ID NO: 9515 - protein, 3 aa, Homo sapiens
  Light chain CDR2
AAS

SEQ ID NO: 9516 - protein, 3 aa, Homo sapiens
  Light chain CDR2
GAS

SEQ ID NO: 9517 - protein, 3 aa, Homo sapiens
  Light chain CDR2
ASS

SEQ ID NO: 9518 - protein, 3 aa, Homo sapiens
  Light chain CDR2
AAS

SEQ ID NO: 9519 - protein, 3 aa, Homo sapiens
  Light chain CDR2
GAS

SEQ ID NO: 9520 - protein, 3 aa, Homo sapiens
  Light chain CDR2
ASS

SEQ ID NO: 9521 - protein, 3 aa, Homo sapiens
  Light chain CDR2
ASS

SEQ ID NO: 9522 - protein, 3 aa, Homo sapiens
  Light chain CDR2
AAS

SEQ ID NO: 9523 - protein, 3 aa, Homo sapiens
  Light chain CDR2
AAS

SEQ ID NO: 9524 - protein, 3 aa, Homo sapiens
  Light chain CDR2
ASS

SEQ ID NO: 9525 - protein, 3 aa, Homo sapiens
  Light chain CDR2
ASS

SEQ ID NO: 9526 - protein, 3 aa, Homo sapiens
  Light chain CDR2
GAS

SEQ ID NO: 9527 - protein, 3 aa, Homo sapiens
  Light chain CDR2
AAS

SEQ ID NO: 9528 - protein, 3 aa, Homo sapiens
  Light chain CDR2
GAS

SEQ ID NO: 9529 - protein, 3 aa, Homo sapiens
  Light chain CDR2
AAS

SEQ ID NO: 9530 - protein, 3 aa, Homo sapiens
  Light chain CDR2
ASS

SEQ ID NO: 9531 - protein, 3 aa, Homo sapiens
  Light chain CDR2
GAS

SEQ ID NO: 9532 - protein, 3 aa, Homo sapiens
  Light chain CDR2
AAS

SEQ ID NO: 9533 - protein, 3 aa, Homo sapiens
  Light chain CDR2
AAS

SEQ ID NO: 9534 - protein, 3 aa, Homo sapiens
  Light chain CDR2
AAS

SEQ ID NO: 9535 - protein, 3 aa, Homo sapiens
  Light chain CDR2
AAS

SEQ ID NO: 9536 - protein, 3 aa, Homo sapiens
  Light chain CDR2
GAS

SEQ ID NO: 9537 - protein, 3 aa, Homo sapiens
  Light chain CDR2
GAS

SEQ ID NO: 9538 - protein, 3 aa, Homo sapiens
  Light chain CDR2
DAS

SEQ ID NO: 9539 - protein, 3 aa, Homo sapiens
  Light chain CDR2
GAS

SEQ ID NO: 9540 - protein, 3 aa, Homo sapiens
  Light chain CDR2
GAS

SEQ ID NO: 9541 - protein, 3 aa, Homo sapiens
  Light chain CDR2
LGS

SEQ ID NO: 9542 - protein, 3 aa, Homo sapiens
  Light chain CDR2
AAS

SEQ ID NO: 9543 - protein, 3 aa, Homo sapiens
  Light chain CDR2
GAS

SEQ ID NO: 9544 - protein, 3 aa, Homo sapiens
  Light chain CDR2
GAS

SEQ ID NO: 9545 - protein, 3 aa, Homo sapiens
  Light chain CDR2
GAS

SEQ ID NO: 9546 - protein, 3 aa, Homo sapiens
  Light chain CDR2
AAS

SEQ ID NO: 9547 - protein, 3 aa, Homo sapiens
  Light chain CDR2
GAS

SEQ ID NO: 9548 - protein, 3 aa, Homo sapiens
  Light chain CDR2
AAS

SEQ ID NO: 9549 - protein, 3 aa, Homo sapiens
  Light chain CDR2
GAS

SEQ ID NO: 9550 - protein, 3 aa, Homo sapiens
  Light chain CDR2
GAS

SEQ ID NO: 9551 - protein, 3 aa, Homo sapiens
  Light chain CDR2
GAS

SEQ ID NO: 9552 - protein, 3 aa, Homo sapiens
  Light chain CDR2
GAS

SEQ ID NO: 9553 - protein, 3 aa, Homo sapiens
  Light chain CDR2
LGS

SEQ ID NO: 9554 - protein, 3 aa, Homo sapiens
  Light chain CDR2
GAS

SEQ ID NO: 9555 - protein, 3 aa, Homo sapiens
  Light chain CDR2
AAS

SEQ ID NO: 9556 - protein, 3 aa, Homo sapiens
  Light chain CDR2
AAS

SEQ ID NO: 9557 - protein, 3 aa, Homo sapiens
  Light chain CDR2
AAS

SEQ ID NO: 9558 - protein, 3 aa, Homo sapiens
  Light chain CDR2
GAS

SEQ ID NO: 9559 - protein, 3 aa, Homo sapiens
  Light chain CDR2
AAS

SEQ ID NO: 9560 - protein, 3 aa, Homo sapiens
  Light chain CDR2
AAS

SEQ ID NO: 9561 - protein, 3 aa, Homo sapiens
  Light chain CDR2
GAS

SEQ ID NO: 9562 - protein, 3 aa, Homo sapiens
  Light chain CDR2
AAS

SEQ ID NO: 9563 - protein, 3 aa, Homo sapiens
  Light chain CDR2
GAS

SEQ ID NO: 9564 - protein, 3 aa, Homo sapiens
  Light chain CDR2
AAS

SEQ ID NO: 9565 - protein, 3 aa, Homo sapiens
  Light chain CDR2
GAS

SEQ ID NO: 9566 - protein, 3 aa, Homo sapiens
  Light chain CDR2
GAS

SEQ ID NO: 9567 - protein, 3 aa, Homo sapiens
  Light chain CDR2
AAS

SEQ ID NO: 9568 - protein, 3 aa, Homo sapiens
  Light chain CDR2
AAS

SEQ ID NO: 9569 - protein, 3 aa, Homo sapiens
  Light chain CDR2
GAS

SEQ ID NO: 9570 - protein, 3 aa, Homo sapiens
  Light chain CDR2
AAS

SEQ ID NO: 9571 - protein, 3 aa, Homo sapiens
  Light chain CDR2
LGS

SEQ ID NO: 9572 - protein, 3 aa, Homo sapiens
  Light chain CDR2
GAS

SEQ ID NO: 9573 - protein, 3 aa, Homo sapiens
  Light chain CDR2
GAS

SEQ ID NO: 9574 - protein, 3 aa, Homo sapiens
  Light chain CDR2
GAS

SEQ ID NO: 9575 - protein, 3 aa, Homo sapiens
  Light chain CDR2
AAS

SEQ ID NO: 9576 - protein, 3 aa, Homo sapiens
  Light chain CDR2
AAS

SEQ ID NO: 9577 - protein, 3 aa, Homo sapiens
  Light chain CDR2
LGS

SEQ ID NO: 9578 - protein, 3 aa, Homo sapiens
  Light chain CDR2
GAS

SEQ ID NO: 9579 - protein, 3 aa, Homo sapiens
  Light chain CDR2
AAS

SEQ ID NO: 9580 - protein, 3 aa, Homo sapiens
  Light chain CDR2
AAS

SEQ ID NO: 9581 - protein, 3 aa, Homo sapiens
  Light chain CDR2
GAS

SEQ ID NO: 9582 - protein, 3 aa, Homo sapiens
  Light chain CDR2
AAS

SEQ ID NO: 9583 - protein, 3 aa, Homo sapiens
  Light chain CDR2
AAS

SEQ ID NO: 9584 - protein, 3 aa, Homo sapiens
  Light chain CDR2
AAS

SEQ ID NO: 9585 - protein, 3 aa, Homo sapiens
  Light chain CDR2
AAS

SEQ ID NO: 9586 - protein, 3 aa, Homo sapiens
  Light chain CDR2
AAS

SEQ ID NO: 9587 - protein, 3 aa, Homo sapiens
  Light chain CDR2
LGS

SEQ ID NO: 9588 - protein, 3 aa, Homo sapiens
  Light chain CDR2
AAS

SEQ ID NO: 9589 - protein, 3 aa, Homo sapiens
  Light chain CDR2
AAS

SEQ ID NO: 9590 - protein, 3 aa, Homo sapiens
  Light chain CDR2
AAS

SEQ ID NO: 9591 - protein, 3 aa, Homo sapiens
  Light chain CDR2
GAS

SEQ ID NO: 9592 - protein, 3 aa, Homo sapiens
  Light chain CDR2
AAS

SEQ ID NO: 9593 - protein, 3 aa, Homo sapiens
  Light chain CDR2
AAS

SEQ ID NO: 9594 - protein, 3 aa, Homo sapiens
  Light chain CDR2
AAS

SEQ ID NO: 9595 - protein, 3 aa, Homo sapiens
  Light chain CDR2
AAS

SEQ ID NO: 9596 - protein, 3 aa, Homo sapiens
  Light chain CDR2
AAS

SEQ ID NO: 9597 - protein, 3 aa, Homo sapiens
  Light chain CDR2
AAS

SEQ ID NO: 9598 - protein, 3 aa, Homo sapiens
  Light chain CDR2
AAS

SEQ ID NO: 9599 - protein, 3 aa, Homo sapiens
  Light chain CDR2
GAS

SEQ ID NO: 9600 - protein, 3 aa, Homo sapiens
  Light chain CDR2
AAS

SEQ ID NO: 9601 - protein, 3 aa, Homo sapiens
  Light chain CDR2
AAS

SEQ ID NO: 9602 - protein, 3 aa, Homo sapiens
  Light chain CDR2
AAS

SEQ ID NO: 9603 - protein, 3 aa, Homo sapiens
  Light chain CDR2
AAS

SEQ ID NO: 9604 - protein, 3 aa, Homo sapiens
  Light chain CDR2
AAS

SEQ ID NO: 9605 - protein, 3 aa, Homo sapiens
  Light chain CDR2
AAS

SEQ ID NO: 9606 - protein, 3 aa, Homo sapiens
  Light chain CDR2
AAS

SEQ ID NO: 9607 - protein, 3 aa, Homo sapiens
  Light chain CDR2
GAS

SEQ ID NO: 9608 - protein, 3 aa, Homo sapiens
  Light chain CDR2
AAS

SEQ ID NO: 9609 - protein, 3 aa, Homo sapiens
  Light chain CDR2
GAS

SEQ ID NO: 9610 - protein, 3 aa, Homo sapiens
  Light chain CDR2
AAS

SEQ ID NO: 9611 - protein, 3 aa, Homo sapiens
  Light chain CDR2
AAS

SEQ ID NO: 9612 - protein, 3 aa, Homo sapiens
  Light chain CDR2
AAS

SEQ ID NO: 9613 - protein, 3 aa, Homo sapiens
  Light chain CDR2
AAS

SEQ ID NO: 9614 - protein, 3 aa, Homo sapiens
  Light chain CDR2
AAS

SEQ ID NO: 9615 - protein, 3 aa, Homo sapiens
  Light chain CDR2
GAS

SEQ ID NO: 9616 - protein, 3 aa, Homo sapiens
  Light chain CDR2
AAS

SEQ ID NO: 9617 - protein, 3 aa, Homo sapiens
  Light chain CDR2
LGS

SEQ ID NO: 9618 - protein, 3 aa, Homo sapiens
  Light chain CDR2
AAS

SEQ ID NO: 9619 - protein, 3 aa, Homo sapiens
  Light chain CDR2
GAS

SEQ ID NO: 9620 - protein, 3 aa, Homo sapiens
  Light chain CDR2
GAS

SEQ ID NO: 9621 - protein, 3 aa, Homo sapiens
  Light chain CDR2
DAS

SEQ ID NO: 9622 - protein, 3 aa, Homo sapiens
  Light chain CDR2
GAS

SEQ ID NO: 9623 - protein, 3 aa, Homo sapiens
  Light chain CDR2
DAS

SEQ ID NO: 9624 - protein, 3 aa, Homo sapiens
  Light chain CDR2
GAS

SEQ ID NO: 9625 - protein, 3 aa, Homo sapiens
  Light chain CDR2
GAS

SEQ ID NO: 9626 - protein, 3 aa, Homo sapiens
  Light chain CDR2
GAS

SEQ ID NO: 9627 - protein, 3 aa, Homo sapiens
  Light chain CDR2
GAS

SEQ ID NO: 9628 - protein, 3 aa, Homo sapiens
  Light chain CDR2
RAS

SEQ ID NO: 9629 - protein, 3 aa, Homo sapiens
  Light chain CDR2
AAS

SEQ ID NO: 9630 - protein, 3 aa, Homo sapiens
  Light chain CDR2
GAS

SEQ ID NO: 9631 - protein, 3 aa, Homo sapiens
  Light chain CDR2
RSS

SEQ ID NO: 9632 - protein, 3 aa, Homo sapiens
  Light chain CDR2
GAS

SEQ ID NO: 9633 - protein, 3 aa, Homo sapiens
  Light chain CDR2
GAS

SEQ ID NO: 9634 - protein, 3 aa, Homo sapiens
  Light chain CDR2
GAS

SEQ ID NO: 9635 - protein, 3 aa, Homo sapiens
  Light chain CDR2
GAS

SEQ ID NO: 9636 - protein, 3 aa, Homo sapiens
  Light chain CDR2
YAS

SEQ ID NO: 9637 - protein, 3 aa, Homo sapiens
  Light chain CDR2
GAS

SEQ ID NO: 9638 - protein, 3 aa, Homo sapiens
  Light chain CDR2
YAS

SEQ ID NO: 9639 - protein, 3 aa, Homo sapiens
  Light chain CDR2
GAS

SEQ ID NO: 9640 - protein, 3 aa, Homo sapiens
  Light chain CDR2
GAS

SEQ ID NO: 9641 - protein, 3 aa, Homo sapiens
  Light chain CDR2
DAS

SEQ ID NO: 9642 - protein, 3 aa, Homo sapiens
  Light chain CDR2
DAS

SEQ ID NO: 9643 - protein, 3 aa, Homo sapiens
  Light chain CDR2
AAS

SEQ ID NO: 9644 - protein, 3 aa, Homo sapiens
  Light chain CDR2
AAS

SEQ ID NO: 9645 - protein, 3 aa, Homo sapiens
  Light chain CDR2
GAS

SEQ ID NO: 9646 - protein, 3 aa, Homo sapiens
  Light chain CDR2
AAS

SEQ ID NO: 9647 - protein, 3 aa, Homo sapiens
  Light chain CDR2
DAS

SEQ ID NO: 9648 - protein, 3 aa, Homo sapiens
  Light chain CDR2
AAS

SEQ ID NO: 9649 - protein, 3 aa, Homo sapiens
  Light chain CDR2
GAS

SEQ ID NO: 9650 - protein, 3 aa, Homo sapiens
  Light chain CDR2
AAS

SEQ ID NO: 9651 - protein, 3 aa, Homo sapiens
  Light chain CDR2
GAS

SEQ ID NO: 9652 - protein, 3 aa, Homo sapiens
  Light chain CDR2
GAS

SEQ ID NO: 9653 - protein, 3 aa, Homo sapiens
  Light chain CDR2
GAS

SEQ ID NO: 9654 - protein, 3 aa, Homo sapiens
  Light chain CDR2
GAS

SEQ ID NO: 9655 - protein, 3 aa, Homo sapiens
  Light chain CDR2
GAS

SEQ ID NO: 9656 - protein, 3 aa, Homo sapiens
  Light chain CDR2
DAS

SEQ ID NO: 9657 - protein, 3 aa, Homo sapiens
  Light chain CDR2
GAS

SEQ ID NO: 9658 - protein, 3 aa, Homo sapiens
  Light chain CDR2
GAS

SEQ ID NO: 9659 - protein, 3 aa, Homo sapiens
  Light chain CDR2
GAS

SEQ ID NO: 9660 - protein, 3 aa, Homo sapiens
  Light chain CDR2
GAS

SEQ ID NO: 9661 - protein, 3 aa, Homo sapiens
  Light chain CDR2
GAS

SEQ ID NO: 9662 - protein, 3 aa, Homo sapiens
  Light chain CDR2
GAS

SEQ ID NO: 9663 - protein, 3 aa, Homo sapiens
  Light chain CDR2
GAS

SEQ ID NO: 9664 - protein, 3 aa, Homo sapiens
  Light chain CDR2
GAS

SEQ ID NO: 9665 - protein, 3 aa, Homo sapiens
  Light chain CDR2
GAS

SEQ ID NO: 9666 - protein, 3 aa, Homo sapiens
  Light chain CDR2
GAS

SEQ ID NO: 9667 - protein, 3 aa, Homo sapiens
  Light chain CDR2
GAS

SEQ ID NO: 9668 - protein, 3 aa, Homo sapiens
  Light chain CDR2
DAS

SEQ ID NO: 9669 - protein, 3 aa, Homo sapiens
  Light chain CDR2
GAS

SEQ ID NO: 9670 - protein, 3 aa, Homo sapiens
  Light chain CDR2
GAS

SEQ ID NO: 9671 - protein, 3 aa, Homo sapiens
  Light chain CDR2
YAS

SEQ ID NO: 9672 - protein, 3 aa, Homo sapiens
  Light chain CDR2
AAS

SEQ ID NO: 9673 - protein, 3 aa, Homo sapiens
  Light chain CDR2
RAS

SEQ ID NO: 9674 - protein, 3 aa, Homo sapiens
  Light chain CDR2
RAS

SEQ ID NO: 9675 - protein, 3 aa, Homo sapiens
  Light chain CDR2
GAS

SEQ ID NO: 9676 - protein, 3 aa, Homo sapiens
  Light chain CDR2
GAS

SEQ ID NO: 9677 - protein, 3 aa, Homo sapiens
  Light chain CDR2
GAS

SEQ ID NO: 9678 - protein, 3 aa, Homo sapiens
  Light chain CDR2
AAS

SEQ ID NO: 9679 - protein, 3 aa, Homo sapiens
  Light chain CDR2
RSS

SEQ ID NO: 9680 - protein, 3 aa, Homo sapiens
  Light chain CDR2
DAS

SEQ ID NO: 9681 - protein, 3 aa, Homo sapiens
  Light chain CDR2
GAS

SEQ ID NO: 9682 - protein, 3 aa, Homo sapiens
  Light chain CDR2
RAS

SEQ ID NO: 9683 - protein, 3 aa, Homo sapiens
  Light chain CDR2
AAS

SEQ ID NO: 9684 - protein, 3 aa, Homo sapiens
  Light chain CDR2
GAS

SEQ ID NO: 9685 - protein, 3 aa, Homo sapiens
  Light chain CDR2
GAS

SEQ ID NO: 9686 - protein, 3 aa, Homo sapiens
  Light chain CDR2
DAS

SEQ ID NO: 9687 - protein, 3 aa, Homo sapiens
  Light chain CDR2
GAS

SEQ ID NO: 9688 - protein, 3 aa, Homo sapiens
  Light chain CDR2
GAS

SEQ ID NO: 9689 - protein, 3 aa, Homo sapiens
  Light chain CDR2
GAS

SEQ ID NO: 9690 - protein, 3 aa, Homo sapiens
  Light chain CDR2
ETS

SEQ ID NO: 9691 - protein, 3 aa, Homo sapiens
  Light chain CDR2
GAS

SEQ ID NO: 9692 - protein, 3 aa, Homo sapiens
  Light chain CDR2
RAS

SEQ ID NO: 9693 - protein, 3 aa, Homo sapiens
  Light chain CDR2
GAS

SEQ ID NO: 9694 - protein, 3 aa, Homo sapiens
  Light chain CDR2
GAS

SEQ ID NO: 9695 - protein, 3 aa, Homo sapiens
  Light chain CDR2
GAS

SEQ ID NO: 9696 - protein, 3 aa, Homo sapiens
  Light chain CDR2
GAS

SEQ ID NO: 9697 - protein, 3 aa, Homo sapiens
  Light chain CDR2
DAS

SEQ ID NO: 9698 - protein, 3 aa, Homo sapiens
  Light chain CDR2
GAS

SEQ ID NO: 9699 - protein, 3 aa, Homo sapiens
  Light chain CDR2
GAS

SEQ ID NO: 9700 - protein, 3 aa, Homo sapiens
  Light chain CDR2
GAS

SEQ ID NO: 9701 - protein, 3 aa, Homo sapiens
  Light chain CDR2
DAS

SEQ ID NO: 9702 - protein, 3 aa, Homo sapiens
  Light chain CDR2
DAS

SEQ ID NO: 9703 - protein, 3 aa, Homo sapiens
  Light chain CDR2
RAS

SEQ ID NO: 9704 - protein, 3 aa, Homo sapiens
  Light chain CDR2
GAS

SEQ ID NO: 9705 - protein, 3 aa, Homo sapiens
  Light chain CDR2
AAS

SEQ ID NO: 9706 - protein, 3 aa, Homo sapiens
  Light chain CDR2
GAS

SEQ ID NO: 9707 - protein, 3 aa, Homo sapiens
  Light chain CDR2
GAS

SEQ ID NO: 9708 - protein, 3 aa, Homo sapiens
  Light chain CDR2
GAS

SEQ ID NO: 9709 - protein, 3 aa, Homo sapiens
  Light chain CDR2
GAS

SEQ ID NO: 9710 - protein, 3 aa, Homo sapiens
  Light chain CDR2
GAS

SEQ ID NO: 9711 - protein, 3 aa, Homo sapiens
  Light chain CDR2
AAS

SEQ ID NO: 9712 - protein, 3 aa, Homo sapiens
  Light chain CDR2
GAS

SEQ ID NO: 9713 - protein, 3 aa, Homo sapiens
  Light chain CDR2
GAS

SEQ ID NO: 9714 - protein, 3 aa, Homo sapiens
  Light chain CDR2
DAS

SEQ ID NO: 9715 - protein, 3 aa, Homo sapiens
  Light chain CDR2
GAS

SEQ ID NO: 9716 - protein, 3 aa, Homo sapiens
  Light chain CDR2
DAS

SEQ ID NO: 9717 - protein, 3 aa, Homo sapiens
  Light chain CDR2
DAS

SEQ ID NO: 9718 - protein, 3 aa, Homo sapiens
  Light chain CDR2
ETS

SEQ ID NO: 9719 - protein, 3 aa, Homo sapiens
  Light chain CDR2
AAS

SEQ ID NO: 9720 - protein, 3 aa, Homo sapiens
  Light chain CDR2
DAS

SEQ ID NO: 9721 - protein, 3 aa, Homo sapiens
  Light chain CDR2
GAS

SEQ ID NO: 9722 - protein, 3 aa, Homo sapiens
  Light chain CDR2
DAS

SEQ ID NO: 9723 - protein, 3 aa, Homo sapiens
  Light chain CDR2
GAS

SEQ ID NO: 9724 - protein, 3 aa, Homo sapiens
  Light chain CDR2
GAS

SEQ ID NO: 9725 - protein, 3 aa, Homo sapiens
  Light chain CDR2
DAS

SEQ ID NO: 9726 - protein, 3 aa, Homo sapiens
  Light chain CDR2
GAS

SEQ ID NO: 9727 - protein, 3 aa, Homo sapiens
  Light chain CDR2
GAS

SEQ ID NO: 9728 - protein, 3 aa, Homo sapiens
  Light chain CDR2
GAS

SEQ ID NO: 9729 - protein, 3 aa, Homo sapiens
  Light chain CDR2
GAS

SEQ ID NO: 9730 - protein, 3 aa, Homo sapiens
  Light chain CDR2
GAS

SEQ ID NO: 9731 - protein, 3 aa, Homo sapiens
  Light chain CDR2
GAS

SEQ ID NO: 9732 - protein, 3 aa, Homo sapiens
  Light chain CDR2
GAS

SEQ ID NO: 9733 - protein, 3 aa, Homo sapiens
  Light chain CDR2
LGS

SEQ ID NO: 9734 - protein, 3 aa, Homo sapiens
  Light chain CDR2
GAS

SEQ ID NO: 9735 - protein, 3 aa, Homo sapiens
  Light chain CDR2
AAS

SEQ ID NO: 9736 - protein, 3 aa, Homo sapiens
  Light chain CDR2
LGS

SEQ ID NO: 9737 - protein, 3 aa, Homo sapiens
  Light chain CDR2
YAS

SEQ ID NO: 9738 - protein, 3 aa, Homo sapiens
  Light chain CDR2
GAS

SEQ ID NO: 9739 - protein, 3 aa, Homo sapiens
  Light chain CDR2
AAS

SEQ ID NO: 9740 - protein, 3 aa, Homo sapiens
  Light chain CDR2
GAS

SEQ ID NO: 9741 - protein, 3 aa, Homo sapiens
  Light chain CDR2
GAS

SEQ ID NO: 9742 - protein, 3 aa, Homo sapiens
  Light chain CDR2
GAS

SEQ ID NO: 9743 - protein, 3 aa, Homo sapiens
  Light chain CDR2
GAS

SEQ ID NO: 9744 - protein, 3 aa, Homo sapiens
  Light chain CDR2
GAS

SEQ ID NO: 9745 - protein, 3 aa, Homo sapiens
  Light chain CDR2
GAS

SEQ ID NO: 9746 - protein, 3 aa, Homo sapiens
  Light chain CDR2
GAS

SEQ ID NO: 9747 - protein, 3 aa, Homo sapiens
  Light chain CDR2
GAS

SEQ ID NO: 9748 - protein, 3 aa, Homo sapiens
  Light chain CDR2
GAS

SEQ ID NO: 9749 - protein, 3 aa, Homo sapiens
  Light chain CDR2
GAS

SEQ ID NO: 9750 - protein, 3 aa, Homo sapiens
  Light chain CDR2
GAS

SEQ ID NO: 9751 - protein, 3 aa, Homo sapiens
  Light chain CDR2
GAS

SEQ ID NO: 9752 - protein, 3 aa, Homo sapiens
  Light chain CDR2
GAS

SEQ ID NO: 9753 - protein, 3 aa, Homo sapiens
  Light chain CDR2
GAS

SEQ ID NO: 9754 - protein, 3 aa, Homo sapiens
  Light chain CDR2
GAS

SEQ ID NO: 9755 - protein, 3 aa, Homo sapiens
  Light chain CDR2
GAS

SEQ ID NO: 9756 - protein, 3 aa, Homo sapiens
  Light chain CDR2
GAS

SEQ ID NO: 9757 - protein, 3 aa, Homo sapiens
  Light chain CDR2
GAS

SEQ ID NO: 9758 - protein, 3 aa, Homo sapiens
  Light chain CDR2
GAS

SEQ ID NO: 9759 - protein, 3 aa, Homo sapiens
  Light chain CDR2
GAS

SEQ ID NO: 9760 - protein, 3 aa, Homo sapiens
  Light chain CDR2
LGS

SEQ ID NO: 9761 - protein, 3 aa, Homo sapiens
  Light chain CDR2
GAS

SEQ ID NO: 9762 - protein, 3 aa, Homo sapiens
  Light chain CDR2
GAS

SEQ ID NO: 9763 - protein, 3 aa, Homo sapiens
  Light chain CDR2
GAS

SEQ ID NO: 9764 - protein, 3 aa, Homo sapiens
  Light chain CDR2
GAS

SEQ ID NO: 9765 - protein, 3 aa, Homo sapiens
  Light chain CDR2
GAS

SEQ ID NO: 9766 - protein, 3 aa, Homo sapiens
  Light chain CDR2
GAS

SEQ ID NO: 9767 - protein, 3 aa, Homo sapiens
  Light chain CDR2
GAS

SEQ ID NO: 9768 - protein, 3 aa, Homo sapiens
  Light chain CDR2
GAS

SEQ ID NO: 9769 - protein, 3 aa, Homo sapiens
  Light chain CDR2
GAS

SEQ ID NO: 9770 - protein, 3 aa, Homo sapiens
  Light chain CDR2
GAS

SEQ ID NO: 9771 - protein, 3 aa, Homo sapiens
  Light chain CDR2
GAS

SEQ ID NO: 9772 - protein, 3 aa, Homo sapiens
  Light chain CDR2
GAS

SEQ ID NO: 9773 - protein, 3 aa, Homo sapiens
  Light chain CDR2
GAS

SEQ ID NO: 9774 - protein, 3 aa, Homo sapiens
  Light chain CDR2
GAS

SEQ ID NO: 9775 - protein, 3 aa, Homo sapiens
  Light chain CDR2
GAS

SEQ ID NO: 9776 - protein, 3 aa, Homo sapiens
  Light chain CDR2
GAS

SEQ ID NO: 9777 - protein, 3 aa, Homo sapiens
  Light chain CDR2
GAS

SEQ ID NO: 9778 - protein, 3 aa, Homo sapiens
  Light chain CDR2
GAS

SEQ ID NO: 9779 - protein, 3 aa, Homo sapiens
  Light chain CDR2
GAS

SEQ ID NO: 9780 - protein, 3 aa, Homo sapiens
  Light chain CDR2
GAS

SEQ ID NO: 9781 - protein, 3 aa, Homo sapiens
  Light chain CDR2
GAS

SEQ ID NO: 9782 - protein, 3 aa, Homo sapiens
  Light chain CDR2
GAS

SEQ ID NO: 9783 - protein, 3 aa, Homo sapiens
  Light chain CDR2
GAS

SEQ ID NO: 9784 - protein, 3 aa, Homo sapiens
  Light chain CDR2
GAS

SEQ ID NO: 9785 - protein, 3 aa, Homo sapiens
  Light chain CDR2
GAS

SEQ ID NO: 9786 - protein, 3 aa, Homo sapiens
  Light chain CDR2
GAS

SEQ ID NO: 9787 - protein, 3 aa, Homo sapiens
  Light chain CDR2
GAS

SEQ ID NO: 9788 - protein, 3 aa, Homo sapiens
  Light chain CDR2
GAS

SEQ ID NO: 9789 - protein, 3 aa, Homo sapiens
  Light chain CDR2
GAS

SEQ ID NO: 9790 - protein, 3 aa, Homo sapiens
  Light chain CDR2
GAS

SEQ ID NO: 9791 - protein, 3 aa, Homo sapiens
  Light chain CDR2
GAS

SEQ ID NO: 9792 - protein, 3 aa, Homo sapiens
  Light chain CDR2
AAS

SEQ ID NO: 9793 - protein, 3 aa, Homo sapiens
  Light chain CDR2
GAS

SEQ ID NO: 9794 - protein, 3 aa, Homo sapiens
  Light chain CDR2
AAS

SEQ ID NO: 9795 - protein, 3 aa, Homo sapiens
  Light chain CDR2
GTS

SEQ ID NO: 9796 - protein, 3 aa, Homo sapiens
  Light chain CDR2
GAS

SEQ ID NO: 9797 - protein, 3 aa, Homo sapiens
  Light chain CDR2
GAS

SEQ ID NO: 9798 - protein, 3 aa, Homo sapiens
  Light chain CDR2
GAS

SEQ ID NO: 9799 - protein, 3 aa, Homo sapiens
  Light chain CDR2
GAS

SEQ ID NO: 9800 - protein, 3 aa, Homo sapiens
  Light chain CDR2
AAS

SEQ ID NO: 9801 - protein, 3 aa, Homo sapiens
  Light chain CDR2
GAS

SEQ ID NO: 9802 - protein, 3 aa, Homo sapiens
  Light chain CDR2
GAS

SEQ ID NO: 9803 - protein, 3 aa, Homo sapiens
  Light chain CDR2
WAS

SEQ ID NO: 9804 - protein, 3 aa, Homo sapiens
  Light chain CDR2
GAS

SEQ ID NO: 9805 - protein, 3 aa, Homo sapiens
  Light chain CDR2
WAS

SEQ ID NO: 9806 - protein, 3 aa, Homo sapiens
  Light chain CDR2
YAS

SEQ ID NO: 9807 - protein, 3 aa, Homo sapiens
  Light chain CDR2
LGS

SEQ ID NO: 9808 - protein, 3 aa, Homo sapiens
  Light chain CDR2
LGS

SEQ ID NO: 9809 - protein, 3 aa, Homo sapiens
  Light chain CDR2
GAS

SEQ ID NO: 9810 - protein, 3 aa, Homo sapiens
  Light chain CDR2
AAS

SEQ ID NO: 9811 - protein, 3 aa, Homo sapiens
  Light chain CDR2
GAS

SEQ ID NO: 9812 - protein, 3 aa, Homo sapiens
  Light chain CDR2
GAS

SEQ ID NO: 9813 - protein, 3 aa, Homo sapiens
  Light chain CDR2
GAS

SEQ ID NO: 9814 - protein, 3 aa, Homo sapiens
  Light chain CDR2
GAS

SEQ ID NO: 9815 - protein, 3 aa, Homo sapiens
  Light chain CDR2
GAS

SEQ ID NO: 9816 - protein, 3 aa, Homo sapiens
  Light chain CDR2
GAS

SEQ ID NO: 9817 - protein, 3 aa, Homo sapiens
  Light chain CDR2
GAS

SEQ ID NO: 9818 - protein, 3 aa, Homo sapiens
  Light chain CDR2
GAS

SEQ ID NO: 9819 - protein, 3 aa, Homo sapiens
  Light chain CDR2
GAS

SEQ ID NO: 9820 - protein, 3 aa, Homo sapiens
  Light chain CDR2
AAS

SEQ ID NO: 9821 - protein, 3 aa, Homo sapiens
  Light chain CDR2
GAS

SEQ ID NO: 9822 - protein, 3 aa, Homo sapiens
  Light chain CDR2
GAS

SEQ ID NO: 9823 - protein, 3 aa, Homo sapiens
  Light chain CDR2
GAS

SEQ ID NO: 9824 - protein, 3 aa, Homo sapiens
  Light chain CDR2
GAS

SEQ ID NO: 9825 - protein, 3 aa, Homo sapiens
  Light chain CDR2
SAS

SEQ ID NO: 9826 - protein, 3 aa, Homo sapiens
  Light chain CDR2
GAS

SEQ ID NO: 9827 - protein, 3 aa, Homo sapiens
  Light chain CDR2
GAS

SEQ ID NO: 9828 - protein, 3 aa, Homo sapiens
  Light chain CDR2
GTS

SEQ ID NO: 9829 - protein, 3 aa, Homo sapiens
  Light chain CDR2
GAS

SEQ ID NO: 9830 - protein, 3 aa, Homo sapiens
  Light chain CDR2
GAS

SEQ ID NO: 9831 - protein, 3 aa, Homo sapiens
  Light chain CDR2
GSS

SEQ ID NO: 9832 - protein, 3 aa, Homo sapiens
  Light chain CDR2
GAS

SEQ ID NO: 9833 - protein, 3 aa, Homo sapiens
  Light chain CDR2
GAS

SEQ ID NO: 9834 - protein, 3 aa, Homo sapiens
  Light chain CDR2
GAS

SEQ ID NO: 9835 - protein, 3 aa, Homo sapiens
  Light chain CDR2
GAS

SEQ ID NO: 9836 - protein, 3 aa, Homo sapiens
  Light chain CDR2
GAS

SEQ ID NO: 9837 - protein, 3 aa, Homo sapiens
  Light chain CDR2
GAS

SEQ ID NO: 9838 - protein, 3 aa, Homo sapiens
  Light chain CDR2
GAS

SEQ ID NO: 9839 - protein, 3 aa, Homo sapiens
  Light chain CDR2
GAS

SEQ ID NO: 9840 - protein, 3 aa, Homo sapiens
  Light chain CDR2
GAS

SEQ ID NO: 9841 - protein, 3 aa, Homo sapiens
  Light chain CDR2
GAS

SEQ ID NO: 9842 - protein, 3 aa, Homo sapiens
  Light chain CDR2
GAS

SEQ ID NO: 9843 - protein, 3 aa, Homo sapiens
  Light chain CDR2
GAS

SEQ ID NO: 9844 - protein, 3 aa, Homo sapiens
  Light chain CDR2
GAS

SEQ ID NO: 9845 - protein, 3 aa, Homo sapiens
  Light chain CDR2
GAS

SEQ ID NO: 9846 - protein, 3 aa, Homo sapiens
  Light chain CDR2
GAS

SEQ ID NO: 9847 - protein, 3 aa, Homo sapiens
  Light chain CDR2
GAS

SEQ ID NO: 9848 - protein, 3 aa, Homo sapiens
  Light chain CDR2
GAS

SEQ ID NO: 9849 - protein, 3 aa, Homo sapiens
  Light chain CDR2
LGS

SEQ ID NO: 9850 - protein, 3 aa, Homo sapiens
  Light chain CDR2
GAS

SEQ ID NO: 9851 - protein, 3 aa, Homo sapiens
  Light chain CDR2
GAS

SEQ ID NO: 9852 - protein, 3 aa, Homo sapiens
  Light chain CDR2
GAS

SEQ ID NO: 9853 - protein, 3 aa, Homo sapiens
  Light chain CDR2
GAS

SEQ ID NO: 9854 - protein, 3 aa, Homo sapiens
  Light chain CDR2
GAS

SEQ ID NO: 9855 - protein, 3 aa, Homo sapiens
  Light chain CDR2
GAS

SEQ ID NO: 9856 - protein, 3 aa, Homo sapiens
  Light chain CDR2
GAS

SEQ ID NO: 9857 - protein, 3 aa, Homo sapiens
  Light chain CDR2
GAS

SEQ ID NO: 9858 - protein, 3 aa, Homo sapiens
  Light chain CDR2
GAS

SEQ ID NO: 9859 - protein, 3 aa, Homo sapiens
  Light chain CDR2
GAS

SEQ ID NO: 9860 - protein, 3 aa, Homo sapiens
  Light chain CDR2
GAS

SEQ ID NO: 9861 - protein, 3 aa, Homo sapiens
  Light chain CDR2
GAS

SEQ ID NO: 9862 - protein, 3 aa, Homo sapiens
  Light chain CDR2
GAS

SEQ ID NO: 9863 - protein, 3 aa, Homo sapiens
  Light chain CDR2
GAS

SEQ ID NO: 9864 - protein, 3 aa, Homo sapiens
  Light chain CDR2
GAS

SEQ ID NO: 9865 - protein, 3 aa, Homo sapiens
  Light chain CDR2
GAS

SEQ ID NO: 9866 - protein, 3 aa, Homo sapiens
  Light chain CDR2
YAS

SEQ ID NO: 9867 - protein, 3 aa, Homo sapiens
  Light chain CDR2
GAS

SEQ ID NO: 9868 - protein, 3 aa, Homo sapiens
  Light chain CDR2
AAS

SEQ ID NO: 9869 - protein, 3 aa, Homo sapiens
  Light chain CDR2
GAS

SEQ ID NO: 9870 - protein, 3 aa, Homo sapiens
  Light chain CDR2
GAS

SEQ ID NO: 9871 - protein, 3 aa, Homo sapiens
  Light chain CDR2
GAS

SEQ ID NO: 9872 - protein, 3 aa, Homo sapiens
  Light chain CDR2
GAS

SEQ ID NO: 9873 - protein, 3 aa, Homo sapiens
  Light chain CDR2
AAS

SEQ ID NO: 9874 - protein, 3 aa, Homo sapiens
  Light chain CDR2
GAS

SEQ ID NO: 9875 - protein, 3 aa, Homo sapiens
  Light chain CDR2
GAS

SEQ ID NO: 9876 - protein, 3 aa, Homo sapiens
  Light chain CDR2
DAS

SEQ ID NO: 9877 - protein, 3 aa, Homo sapiens
  Light chain CDR2
GAS

SEQ ID NO: 9878 - protein, 3 aa, Homo sapiens
  Light chain CDR2
GAS

SEQ ID NO: 9879 - protein, 3 aa, Homo sapiens
  Light chain CDR2
GAS

SEQ ID NO: 9880 - protein, 3 aa, Homo sapiens
  Light chain CDR2
AAS

SEQ ID NO: 9881 - protein, 3 aa, Homo sapiens
  Light chain CDR2
KVS

SEQ ID NO: 9882 - protein, 3 aa, Homo sapiens
  Light chain CDR2
GAS

SEQ ID NO: 9883 - protein, 3 aa, Homo sapiens
  Light chain CDR2
GAS

SEQ ID NO: 9884 - protein, 3 aa, Homo sapiens
  Light chain CDR2
LGS

SEQ ID NO: 9885 - protein, 3 aa, Homo sapiens
  Light chain CDR2
GAS

SEQ ID NO: 9886 - protein, 3 aa, Homo sapiens
  Light chain CDR2
AAS

SEQ ID NO: 9887 - protein, 3 aa, Homo sapiens
  Light chain CDR2
GAS

SEQ ID NO: 9888 - protein, 3 aa, Homo sapiens
  Light chain CDR2
AAS

SEQ ID NO: 9889 - protein, 3 aa, Homo sapiens
  Light chain CDR2
AAS

SEQ ID NO: 9890 - protein, 3 aa, Homo sapiens
  Light chain CDR2
GAS

SEQ ID NO: 9891 - protein, 3 aa, Homo sapiens
  Light chain CDR2
AAS

SEQ ID NO: 9892 - protein, 3 aa, Homo sapiens
  Light chain CDR2
AAS

SEQ ID NO: 9893 - protein, 3 aa, Homo sapiens
  Light chain CDR2
GAS

SEQ ID NO: 9894 - protein, 3 aa, Homo sapiens
  Light chain CDR2
AAS

SEQ ID NO: 9895 - protein, 3 aa, Homo sapiens
  Light chain CDR2
GAS

SEQ ID NO: 9896 - protein, 3 aa, Homo sapiens
  Light chain CDR2
GAS

SEQ ID NO: 9897 - protein, 3 aa, Homo sapiens
  Light chain CDR2
AAS

SEQ ID NO: 9898 - protein, 3 aa, Homo sapiens
  Light chain CDR2
GAS

SEQ ID NO: 9899 - protein, 3 aa, Homo sapiens
  Light chain CDR2
GAS

SEQ ID NO: 9900 - protein, 3 aa, Homo sapiens
  Light chain CDR2
GAS

SEQ ID NO: 9901 - protein, 3 aa, Homo sapiens
  Light chain CDR2
GAS

SEQ ID NO: 9902 - protein, 3 aa, Homo sapiens
  Light chain CDR2
GAS

SEQ ID NO: 9903 - protein, 3 aa, Homo sapiens
  Light chain CDR2
GAS

SEQ ID NO: 9904 - protein, 3 aa, Homo sapiens
  Light chain CDR2
AAS

SEQ ID NO: 9905 - protein, 3 aa, Homo sapiens
  Light chain CDR2
GAS

SEQ ID NO: 9906 - protein, 3 aa, Homo sapiens
  Light chain CDR2
YAS

SEQ ID NO: 9907 - protein, 3 aa, Homo sapiens
  Light chain CDR2
AAS

SEQ ID NO: 9908 - protein, 3 aa, Homo sapiens
  Light chain CDR2
AAS

SEQ ID NO: 9909 - protein, 3 aa, Homo sapiens
  Light chain CDR2
GAS

SEQ ID NO: 9910 - protein, 3 aa, Homo sapiens
  Light chain CDR2
GAS

SEQ ID NO: 9911 - protein, 3 aa, Homo sapiens
  Light chain CDR2
AAS

SEQ ID NO: 9912 - protein, 3 aa, Homo sapiens
  Light chain CDR2
GAS

SEQ ID NO: 9913 - protein, 3 aa, Homo sapiens
  Light chain CDR2
GAS

SEQ ID NO: 9914 - protein, 3 aa, Homo sapiens
  Light chain CDR2
GAS

SEQ ID NO: 9915 - protein, 3 aa, Homo sapiens
  Light chain CDR2
GAS

SEQ ID NO: 9916 - protein, 3 aa, Homo sapiens
  Light chain CDR2
GAS

SEQ ID NO: 9917 - protein, 3 aa, Homo sapiens
  Light chain CDR2
GAS

SEQ ID NO: 9918 - protein, 3 aa, Homo sapiens
  Light chain CDR2
GAS

SEQ ID NO: 9919 - protein, 3 aa, Homo sapiens
  Light chain CDR2
AAS

SEQ ID NO: 9920 - protein, 3 aa, Homo sapiens
  Light chain CDR2
GAS

SEQ ID NO: 9921 - protein, 3 aa, Homo sapiens
  Light chain CDR2
GAS

SEQ ID NO: 9922 - protein, 3 aa, Homo sapiens
  Light chain CDR2
GAS

SEQ ID NO: 9923 - protein, 3 aa, Homo sapiens
  Light chain CDR2
GAS

SEQ ID NO: 9924 - protein, 3 aa, Homo sapiens
  Light chain CDR2
GAS

SEQ ID NO: 9925 - protein, 3 aa, Homo sapiens
  Light chain CDR2
GAS

SEQ ID NO: 9926 - protein, 3 aa, Homo sapiens
  Light chain CDR2
AAS

SEQ ID NO: 9927 - protein, 3 aa, Homo sapiens
  Light chain CDR2
GAS

SEQ ID NO: 9928 - protein, 3 aa, Homo sapiens
  Light chain CDR2
GAS

SEQ ID NO: 9929 - protein, 3 aa, Homo sapiens
  Light chain CDR2
GAS

SEQ ID NO: 9930 - protein, 3 aa, Homo sapiens
  Light chain CDR2
DAS

SEQ ID NO: 9931 - protein, 3 aa, Homo sapiens
  Light chain CDR2
GAS

SEQ ID NO: 9932 - protein, 3 aa, Homo sapiens
  Light chain CDR2
GAS

SEQ ID NO: 9933 - protein, 3 aa, Homo sapiens
  Light chain CDR2
GAS

SEQ ID NO: 9934 - protein, 3 aa, Homo sapiens
  Light chain CDR2
GAS

SEQ ID NO: 9935 - protein, 3 aa, Homo sapiens
  Light chain CDR2
GAS

SEQ ID NO: 9936 - protein, 3 aa, Homo sapiens
  Light chain CDR2
GAS

SEQ ID NO: 9937 - protein, 3 aa, Homo sapiens
  Light chain CDR2
GAS

SEQ ID NO: 9938 - protein, 3 aa, Homo sapiens
  Light chain CDR2
GAS

SEQ ID NO: 9939 - protein, 3 aa, Homo sapiens
  Light chain CDR2
GAS

SEQ ID NO: 9940 - protein, 3 aa, Homo sapiens
  Light chain CDR2
GAS

SEQ ID NO: 9941 - protein, 3 aa, Homo sapiens
  Light chain CDR2
GAS

SEQ ID NO: 9942 - protein, 3 aa, Homo sapiens
  Light chain CDR2
AAS

SEQ ID NO: 9943 - protein, 3 aa, Homo sapiens
  Light chain CDR2
DTS

SEQ ID NO: 9944 - protein, 3 aa, Homo sapiens
  Light chain CDR2
GSS

SEQ ID NO: 9945 - protein, 3 aa, Homo sapiens
  Light chain CDR2
LGS

SEQ ID NO: 9946 - protein, 3 aa, Homo sapiens
  Light chain CDR2
GAS

SEQ ID NO: 9947 - protein, 3 aa, Homo sapiens
  Light chain CDR2
DTS

SEQ ID NO: 9948 - protein, 3 aa, Homo sapiens
  Light chain CDR2
GAS

SEQ ID NO: 9949 - protein, 3 aa, Homo sapiens
  Light chain CDR2
GAS

SEQ ID NO: 9950 - protein, 3 aa, Homo sapiens
  Light chain CDR2
AAS

SEQ ID NO: 9951 - protein, 3 aa, Homo sapiens
  Light chain CDR2
GAS

SEQ ID NO: 9952 - protein, 3 aa, Homo sapiens
  Light chain CDR2
GAS

SEQ ID NO: 9953 - protein, 3 aa, Homo sapiens
  Light chain CDR2
GAS

SEQ ID NO: 9954 - protein, 3 aa, Homo sapiens
  Light chain CDR2
GAS

SEQ ID NO: 9955 - protein, 3 aa, Homo sapiens
  Light chain CDR2
GAS

SEQ ID NO: 9956 - protein, 3 aa, Homo sapiens
  Light chain CDR2
GAS

SEQ ID NO: 9957 - protein, 3 aa, Homo sapiens
  Light chain CDR2
GAS

SEQ ID NO: 9958 - protein, 3 aa, Homo sapiens
  Light chain CDR2
GAS

SEQ ID NO: 9959 - protein, 3 aa, Homo sapiens
  Light chain CDR2
GAS

SEQ ID NO: 9960 - protein, 3 aa, Homo sapiens
  Light chain CDR2
GSS

SEQ ID NO: 9961 - protein, 3 aa, Homo sapiens
  Light chain CDR2
DAS

SEQ ID NO: 9962 - protein, 3 aa, Homo sapiens
  Light chain CDR2
GAS

SEQ ID NO: 9963 - protein, 3 aa, Homo sapiens
  Light chain CDR2
GAS

SEQ ID NO: 9964 - protein, 3 aa, Homo sapiens
  Light chain CDR2
GAS

SEQ ID NO: 9965 - protein, 3 aa, Homo sapiens
  Light chain CDR2
AAS

SEQ ID NO: 9966 - protein, 3 aa, Homo sapiens
  Light chain CDR2
GAS

SEQ ID NO: 9967 - protein, 3 aa, Homo sapiens
  Light chain CDR2
GAS

SEQ ID NO: 9968 - protein, 3 aa, Homo sapiens
  Light chain CDR2
GAS

SEQ ID NO: 9969 - protein, 3 aa, Homo sapiens
  Light chain CDR2
DAS

SEQ ID NO: 9970 - protein, 3 aa, Homo sapiens
  Light chain CDR2
GAS

SEQ ID NO: 9971 - protein, 3 aa, Homo sapiens
  Light chain CDR2
GAS

SEQ ID NO: 9972 - protein, 3 aa, Homo sapiens
  Light chain CDR2
GAS

SEQ ID NO: 9973 - protein, 3 aa, Homo sapiens
  Light chain CDR2
GAS

SEQ ID NO: 9974 - protein, 3 aa, Homo sapiens
  Light chain CDR2
GSS

SEQ ID NO: 9975 - protein, 3 aa, Homo sapiens
  Light chain CDR2
GAS

SEQ ID NO: 9976 - protein, 3 aa, Homo sapiens
  Light chain CDR2
GAS

SEQ ID NO: 9977 - protein, 3 aa, Homo sapiens
  Light chain CDR2
GAS

SEQ ID NO: 9978 - protein, 3 aa, Homo sapiens
  Light chain CDR2
GAS

SEQ ID NO: 9979 - protein, 3 aa, Homo sapiens
  Light chain CDR2
GAS

SEQ ID NO: 9980 - protein, 3 aa, Homo sapiens
  Light chain CDR2
GAS

SEQ ID NO: 9981 - protein, 3 aa, Homo sapiens
  Light chain CDR2
GAS

SEQ ID NO: 9982 - protein, 3 aa, Homo sapiens
  Light chain CDR2
GAS

SEQ ID NO: 9983 - protein, 3 aa, Homo sapiens
  Light chain CDR2
DTS

SEQ ID NO: 9984 - protein, 9 aa, Homo sapiens
  Light chain CDR3
QQSYSTPYT

SEQ ID NO: 9985 - protein, 9 aa, Homo sapiens
  Light chain CDR3
QKYNSAPLT

SEQ ID NO: 9986 - protein, 9 aa, Homo sapiens
  Light chain CDR3
QQYNNWPYT

SEQ ID NO: 9987 - protein, 9 aa, Homo sapiens
  Light chain CDR3
LQHNTYPFT

SEQ ID NO: 9988 - protein, 9 aa, Homo sapiens
  Light chain CDR3
LQHNSYPYT

SEQ ID NO: 9989 - protein, 9 aa, Homo sapiens
  Light chain CDR3
LQHNSYPYT

SEQ ID NO: 9990 - protein, 9 aa, Homo sapiens
  Light chain CDR3
QQFNSYPYT

SEQ ID NO: 9991 - protein, 9 aa, Homo sapiens
  Light chain CDR3
QQYGNSPYT

SEQ ID NO: 9992 - protein, 9 aa, Homo sapiens
  Light chain CDR3
LQHNSYPWT

SEQ ID NO: 9993 - protein, 9 aa, Homo sapiens
  Light chain CDR3
LQHNSYPWT

SEQ ID NO: 9994 - protein, 9 aa, Homo sapiens
  Light chain CDR3
LQHNSYPWT

SEQ ID NO: 9995 - protein, 9 aa, Homo sapiens
  Light chain CDR3
LQHNSYPFT

SEQ ID NO: 9996 - protein, 9 aa, Homo sapiens
  Light chain CDR3
QQYGSSPRT

SEQ ID NO: 9997 - protein, 8 aa, Homo sapiens
  Light chain CDR3
QQYGSSYT

SEQ ID NO: 9998 - protein, 9 aa, Homo sapiens
  Light chain CDR3
QKYNSAPYT

SEQ ID NO: 9999 - protein, 9 aa, Homo sapiens
  Light chain CDR3
QQLNSYPRT

SEQ ID NO: 10000 - protein, 9 aa, Homo sapiens
  Light chain CDR3
LQHNSYPWT

SEQ ID NO: 10001 - protein, 9 aa, Homo sapiens
  Light chain CDR3
QQSYSTPIT

SEQ ID NO: 10002 - protein, 9 aa, Homo sapiens
  Light chain CDR3
QQLNSYPYT

SEQ ID NO: 10003 - protein, 9 aa, Homo sapiens
  Light chain CDR3
QQSYSTPYT

SEQ ID NO: 10004 - protein, 9 aa, Homo sapiens
  Light chain CDR3
QQSYSTPYT

SEQ ID NO: 10005 - protein, 9 aa, Homo sapiens
  Light chain CDR3
QQSYSTPIT

SEQ ID NO: 10006 - protein, 9 aa, Homo sapiens
  Light chain CDR3
QQSYSYPYT

SEQ ID NO: 10007 - protein, 9 aa, Homo sapiens
  Light chain CDR3
QQSYSTPYT

SEQ ID NO: 10008 - protein, 9 aa, Homo sapiens
  Light chain CDR3
QQFNSYPYT

SEQ ID NO: 10009 - protein, 9 aa, Homo sapiens
  Light chain CDR3
QQSYSTPYT

SEQ ID NO: 10010 - protein, 9 aa, Homo sapiens
  Light chain CDR3
LQHNSYPWT

SEQ ID NO: 10011 - protein, 9 aa, Homo sapiens
  Light chain CDR3
QQLNSYPRT

SEQ ID NO: 10012 - protein, 9 aa, Homo sapiens
  Light chain CDR3
QQYGSSPYT

SEQ ID NO: 10013 - protein, 9 aa, Homo sapiens
  Light chain CDR3
QQSYSTPYT

SEQ ID NO: 10014 - protein, 9 aa, Homo sapiens
  Light chain CDR3
LQDYNYPWT

SEQ ID NO: 10015 - protein, 8 aa, Homo sapiens
  Light chain CDR3
QQYGSSYT

SEQ ID NO: 10016 - protein, 9 aa, Homo sapiens
  Light chain CDR3
QQSYSTPYT

SEQ ID NO: 10017 - protein, 9 aa, Homo sapiens
  Light chain CDR3
QQSYSTPYT

SEQ ID NO: 10018 - protein, 9 aa, Homo sapiens
  Light chain CDR3
LQHNSYPWT

SEQ ID NO: 10019 - protein, 9 aa, Homo sapiens
  Light chain CDR3
QQFNSYPYT

SEQ ID NO: 10020 - protein, 9 aa, Homo sapiens
  Light chain CDR3
QQSYSTPYT

SEQ ID NO: 10021 - protein, 9 aa, Homo sapiens
  Light chain CDR3
QQSYSTPYT

SEQ ID NO: 10022 - protein, 8 aa, Homo sapiens
  Light chain CDR3
QQYGSSYT

SEQ ID NO: 10023 - protein, 9 aa, Homo sapiens
  Light chain CDR3
LQHNSYPWT

SEQ ID NO: 10024 - protein, 9 aa, Homo sapiens
  Light chain CDR3
QQDYNLPYT

SEQ ID NO: 10025 - protein, 9 aa, Homo sapiens
  Light chain CDR3
QQSYSNPLT

SEQ ID NO: 10026 - protein, 9 aa, Homo sapiens
  Light chain CDR3
QQSYSTPYT

SEQ ID NO: 10027 - protein, 9 aa, Homo sapiens
  Light chain CDR3
QQDYNLPLT

SEQ ID NO: 10028 - protein, 9 aa, Homo sapiens
  Light chain CDR3
QQFNSYPYT

SEQ ID NO: 10029 - protein, 9 aa, Homo sapiens
  Light chain CDR3
LQHNSYPWT

SEQ ID NO: 10030 - protein, 9 aa, Homo sapiens
  Light chain CDR3
QQSYSTPFT

SEQ ID NO: 10031 - protein, 9 aa, Homo sapiens
  Light chain CDR3
QQSYSTPFT

SEQ ID NO: 10032 - protein, 9 aa, Homo sapiens
  Light chain CDR3
QQYGSSPWT

SEQ ID NO: 10033 - protein, 9 aa, Homo sapiens
  Light chain CDR3
QQYGSSPFT

SEQ ID NO: 10034 - protein, 9 aa, Homo sapiens
  Light chain CDR3
QQYDNLPIT

SEQ ID NO: 10035 - protein, 9 aa, Homo sapiens
  Light chain CDR3
QQYGSSPWT

SEQ ID NO: 10036 - protein, 9 aa, Homo sapiens
  Light chain CDR3
QQYGSSPWT

SEQ ID NO: 10037 - protein, 9 aa, Homo sapiens
  Light chain CDR3
MQALQTPLT

SEQ ID NO: 10038 - protein, 9 aa, Homo sapiens
  Light chain CDR3
QQSYSTPFT

SEQ ID NO: 10039 - protein, 9 aa, Homo sapiens
  Light chain CDR3
QQYGSSPWT

SEQ ID NO: 10040 - protein, 9 aa, Homo sapiens
  Light chain CDR3
QQYGRSPWT

SEQ ID NO: 10041 - protein, 9 aa, Homo sapiens
  Light chain CDR3
QQYGNSPWT

SEQ ID NO: 10042 - protein, 9 aa, Homo sapiens
  Light chain CDR3
QQSYSTPFT

SEQ ID NO: 10043 - protein, 9 aa, Homo sapiens
  Light chain CDR3
QQYGTSPWT

SEQ ID NO: 10044 - protein, 9 aa, Homo sapiens
  Light chain CDR3
QQSYSTPFT

SEQ ID NO: 10045 - protein, 9 aa, Homo sapiens
  Light chain CDR3
QQYGSSPFT

SEQ ID NO: 10046 - protein, 9 aa, Homo sapiens
  Light chain CDR3
QQYGSSPFT

SEQ ID NO: 10047 - protein, 9 aa, Homo sapiens
  Light chain CDR3
QQYGSSPFT

SEQ ID NO: 10048 - protein, 9 aa, Homo sapiens
  Light chain CDR3
QQYGSSPWT

SEQ ID NO: 10049 - protein, 9 aa, Homo sapiens
  Light chain CDR3
MQALQTPLT

SEQ ID NO: 10050 - protein, 9 aa, Homo sapiens
  Light chain CDR3
QQYGSSPFT

SEQ ID NO: 10051 - protein, 9 aa, Homo sapiens
  Light chain CDR3
QQSYSTPFT

SEQ ID NO: 10052 - protein, 9 aa, Homo sapiens
  Light chain CDR3
QQSYSTPFT

SEQ ID NO: 10053 - protein, 9 aa, Homo sapiens
  Light chain CDR3
QQGYSTPFT

SEQ ID NO: 10054 - protein, 9 aa, Homo sapiens
  Light chain CDR3
QQYGSSPWT

SEQ ID NO: 10055 - protein, 9 aa, Homo sapiens
  Light chain CDR3
QQSYSTPFA

SEQ ID NO: 10056 - protein, 9 aa, Homo sapiens
  Light chain CDR3
QQSYSTPFT

SEQ ID NO: 10057 - protein, 9 aa, Homo sapiens
  Light chain CDR3
QQYGSSPFT

SEQ ID NO: 10058 - protein, 9 aa, Homo sapiens
  Light chain CDR3
QQSYSTPFT

SEQ ID NO: 10059 - protein, 9 aa, Homo sapiens
  Light chain CDR3
QQYGSSPWT

SEQ ID NO: 10060 - protein, 9 aa, Homo sapiens
  Light chain CDR3
QQSYSTPFT

SEQ ID NO: 10061 - protein, 9 aa, Homo sapiens
  Light chain CDR3
QQYGSSPWT

SEQ ID NO: 10062 - protein, 9 aa, Homo sapiens
  Light chain CDR3
QQYGSSPWT

SEQ ID NO: 10063 - protein, 9 aa, Homo sapiens
  Light chain CDR3
QQSYSTPFT

SEQ ID NO: 10064 - protein, 9 aa, Homo sapiens
  Light chain CDR3
QQSYSTPFT

SEQ ID NO: 10065 - protein, 9 aa, Homo sapiens
  Light chain CDR3
QQFGSSPWT

SEQ ID NO: 10066 - protein, 9 aa, Homo sapiens
  Light chain CDR3
QQLNSYPRT

SEQ ID NO: 10067 - protein, 9 aa, Homo sapiens
  Light chain CDR3
MQALQTPLT

SEQ ID NO: 10068 - protein, 9 aa, Homo sapiens
  Light chain CDR3
QQYGTSPWT

SEQ ID NO: 10069 - protein, 9 aa, Homo sapiens
  Light chain CDR3
QQYGTSPFT

SEQ ID NO: 10070 - protein, 9 aa, Homo sapiens
  Light chain CDR3
QQYGNSPWT

SEQ ID NO: 10071 - protein, 9 aa, Homo sapiens
  Light chain CDR3
QQSYSTPYT

SEQ ID NO: 10072 - protein, 9 aa, Homo sapiens
  Light chain CDR3
LQHNSYPWT

SEQ ID NO: 10073 - protein, 9 aa, Homo sapiens
  Light chain CDR3
MQALQTPLT

SEQ ID NO: 10074 - protein, 9 aa, Homo sapiens
  Light chain CDR3
QQYGSSPFT

SEQ ID NO: 10075 - protein, 9 aa, Homo sapiens
  Light chain CDR3
LQHNSYPRT

SEQ ID NO: 10076 - protein, 9 aa, Homo sapiens
  Light chain CDR3
LQHNSYPWT

SEQ ID NO: 10077 - protein, 9 aa, Homo sapiens
  Light chain CDR3
QQYGNSPWT

SEQ ID NO: 10078 - protein, 9 aa, Homo sapiens
  Light chain CDR3
LQDYNYPRT

SEQ ID NO: 10079 - protein, 9 aa, Homo sapiens
  Light chain CDR3
LQDYNYPYT

SEQ ID NO: 10080 - protein, 9 aa, Homo sapiens
  Light chain CDR3
QQLNSYPRT

SEQ ID NO: 10081 - protein, 9 aa, Homo sapiens
  Light chain CDR3
QQSYSTPFT

SEQ ID NO: 10082 - protein, 9 aa, Homo sapiens
  Light chain CDR3
LQDYNYPRT

SEQ ID NO: 10083 - protein, 9 aa, Homo sapiens
  Light chain CDR3
MQALQTPLT

SEQ ID NO: 10084 - protein, 9 aa, Homo sapiens
  Light chain CDR3
LQHNSYPWT

SEQ ID NO: 10085 - protein, 9 aa, Homo sapiens
  Light chain CDR3
LQLNSYPRT

SEQ ID NO: 10086 - protein, 9 aa, Homo sapiens
  Light chain CDR3
LQNYNYPRT

SEQ ID NO: 10087 - protein, 9 aa, Homo sapiens
  Light chain CDR3
QQDYNLPYT

SEQ ID NO: 10088 - protein, 9 aa, Homo sapiens
  Light chain CDR3
QQSYSTPYT

SEQ ID NO: 10089 - protein, 9 aa, Homo sapiens
  Light chain CDR3
QQLNSYPRT

SEQ ID NO: 10090 - protein, 9 aa, Homo sapiens
  Light chain CDR3
LQHNSYPWT

SEQ ID NO: 10091 - protein, 9 aa, Homo sapiens
  Light chain CDR3
QQYNSYPYT

SEQ ID NO: 10092 - protein, 9 aa, Homo sapiens
  Light chain CDR3
LQDYNYPWT

SEQ ID NO: 10093 - protein, 9 aa, Homo sapiens
  Light chain CDR3
QQYNSYPRT

SEQ ID NO: 10094 - protein, 9 aa, Homo sapiens
  Light chain CDR3
QQSYSTPFT

SEQ ID NO: 10095 - protein, 9 aa, Homo sapiens
  Light chain CDR3
QQYGSSPLT

SEQ ID NO: 10096 - protein, 9 aa, Homo sapiens
  Light chain CDR3
LQHNSYPYT

SEQ ID NO: 10097 - protein, 9 aa, Homo sapiens
  Light chain CDR3
QQSYSTPFT

SEQ ID NO: 10098 - protein, 9 aa, Homo sapiens
  Light chain CDR3
QQSYSTPFT

SEQ ID NO: 10099 - protein, 9 aa, Homo sapiens
  Light chain CDR3
LQLNSYPRT

SEQ ID NO: 10100 - protein, 9 aa, Homo sapiens
  Light chain CDR3
LQDYNYPWT

SEQ ID NO: 10101 - protein, 9 aa, Homo sapiens
  Light chain CDR3
LQHNSYPRT

SEQ ID NO: 10102 - protein, 9 aa, Homo sapiens
  Light chain CDR3
KQSYSTPYT

SEQ ID NO: 10103 - protein, 9 aa, Homo sapiens
  Light chain CDR3
QQYGNSPWT

SEQ ID NO: 10104 - protein, 9 aa, Homo sapiens
  Light chain CDR3
LQRNSYPWT

SEQ ID NO: 10105 - protein, 9 aa, Homo sapiens
  Light chain CDR3
QQFGSSPWT

SEQ ID NO: 10106 - protein, 9 aa, Homo sapiens
  Light chain CDR3
LQHNSYPWT

SEQ ID NO: 10107 - protein, 9 aa, Homo sapiens
  Light chain CDR3
RQLNSYPWT

SEQ ID NO: 10108 - protein, 9 aa, Homo sapiens
  Light chain CDR3
QQYNSYPRT

SEQ ID NO: 10109 - protein, 9 aa, Homo sapiens
  Light chain CDR3
QQLNSYPWT

SEQ ID NO: 10110 - protein, 9 aa, Homo sapiens
  Light chain CDR3
KQLNSYPRT

SEQ ID NO: 10111 - protein, 9 aa, Homo sapiens
  Light chain CDR3
QQFGSSPWT

SEQ ID NO: 10112 - protein, 9 aa, Homo sapiens
  Light chain CDR3
QQLNSYPRT

SEQ ID NO: 10113 - protein, 9 aa, Homo sapiens
  Light chain CDR3
MQALQTPLT

SEQ ID NO: 10114 - protein, 9 aa, Homo sapiens
  Light chain CDR3
QQSYSTPYT

SEQ ID NO: 10115 - protein, 9 aa, Homo sapiens
  Light chain CDR3
QQYGSSPWT

SEQ ID NO: 10116 - protein, 9 aa, Homo sapiens
  Light chain CDR3
QQYNSYPYT

SEQ ID NO: 10117 - protein, 9 aa, Homo sapiens
  Light chain CDR3
QQYKSYPYT

SEQ ID NO: 10118 - protein, 9 aa, Homo sapiens
  Light chain CDR3
QQYGNSPFT

SEQ ID NO: 10119 - protein, 9 aa, Homo sapiens
  Light chain CDR3
QQYKSYPYT

SEQ ID NO: 10120 - protein, 9 aa, Homo sapiens
  Light chain CDR3
QQYGSSPFT

SEQ ID NO: 10121 - protein, 9 aa, Homo sapiens
  Light chain CDR3
QQYGSSPWT

SEQ ID NO: 10122 - protein, 9 aa, Homo sapiens
  Light chain CDR3
QQYGRSPFT

SEQ ID NO: 10123 - protein, 9 aa, Homo sapiens
  Light chain CDR3
QQYGRSPFT

SEQ ID NO: 10124 - protein, 9 aa, Homo sapiens
  Light chain CDR3
QRTYSAPYT

SEQ ID NO: 10125 - protein, 9 aa, Homo sapiens
  Light chain CDR3
QQLNNYPYT

SEQ ID NO: 10126 - protein, 9 aa, Homo sapiens
  Light chain CDR3
QQYGSSPFT

SEQ ID NO: 10127 - protein, 9 aa, Homo sapiens
  Light chain CDR3
QRTYNAPYT

SEQ ID NO: 10128 - protein, 9 aa, Homo sapiens
  Light chain CDR3
QQFGSSPWT

SEQ ID NO: 10129 - protein, 9 aa, Homo sapiens
  Light chain CDR3
QQYGSSPFT

SEQ ID NO: 10130 - protein, 9 aa, Homo sapiens
  Light chain CDR3
QQYGSSPFT

SEQ ID NO: 10131 - protein, 9 aa, Homo sapiens
  Light chain CDR3
QQYGSSPWT

SEQ ID NO: 10132 - protein, 9 aa, Homo sapiens
  Light chain CDR3
HQSSSLPFT

SEQ ID NO: 10133 - protein, 9 aa, Homo sapiens
  Light chain CDR3
QQYGTSPWT

SEQ ID NO: 10134 - protein, 9 aa, Homo sapiens
  Light chain CDR3
HQSSSLPFT

SEQ ID NO: 10135 - protein, 9 aa, Homo sapiens
  Light chain CDR3
QQDYNLPFT

SEQ ID NO: 10136 - protein, 9 aa, Homo sapiens
  Light chain CDR3
QQFGSSPFT

SEQ ID NO: 10137 - protein, 9 aa, Homo sapiens
  Light chain CDR3
QQYKSYPYT

SEQ ID NO: 10138 - protein, 9 aa, Homo sapiens
  Light chain CDR3
QQYKSYPYT

SEQ ID NO: 10139 - protein, 9 aa, Homo sapiens
  Light chain CDR3
QKYDSAPFT

SEQ ID NO: 10140 - protein, 9 aa, Homo sapiens
  Light chain CDR3
QQLNNYPYT

SEQ ID NO: 10141 - protein, 9 aa, Homo sapiens
  Light chain CDR3
QQYGSSPWT

SEQ ID NO: 10142 - protein, 9 aa, Homo sapiens
  Light chain CDR3
QQLNNYPST

SEQ ID NO: 10143 - protein, 9 aa, Homo sapiens
  Light chain CDR3
QQYKSYPYT

SEQ ID NO: 10144 - protein, 9 aa, Homo sapiens
  Light chain CDR3
QQLNNYPCT

SEQ ID NO: 10145 - protein, 9 aa, Homo sapiens
  Light chain CDR3
QQYGSSPWT

SEQ ID NO: 10146 - protein, 9 aa, Homo sapiens
  Light chain CDR3
QQLNNYPYT

SEQ ID NO: 10147 - protein, 9 aa, Homo sapiens
  Light chain CDR3
QQFGRSPFT

SEQ ID NO: 10148 - protein, 9 aa, Homo sapiens
  Light chain CDR3
QQYGSSPWT

SEQ ID NO: 10149 - protein, 9 aa, Homo sapiens
  Light chain CDR3
QQYGTSPFT

SEQ ID NO: 10150 - protein, 9 aa, Homo sapiens
  Light chain CDR3
QQYGSSPFT

SEQ ID NO: 10151 - protein, 9 aa, Homo sapiens
  Light chain CDR3
QQYGRSPFT

SEQ ID NO: 10152 - protein, 9 aa, Homo sapiens
  Light chain CDR3
QQYKSYPYT

SEQ ID NO: 10153 - protein, 9 aa, Homo sapiens
  Light chain CDR3
QQYSRSPWT

SEQ ID NO: 10154 - protein, 9 aa, Homo sapiens
  Light chain CDR3
QQYKTYPYT

SEQ ID NO: 10155 - protein, 9 aa, Homo sapiens
  Light chain CDR3
QQYGSSPWT

SEQ ID NO: 10156 - protein, 9 aa, Homo sapiens
  Light chain CDR3
QQFGSSPFT

SEQ ID NO: 10157 - protein, 9 aa, Homo sapiens
  Light chain CDR3
QQYGSSPFT

SEQ ID NO: 10158 - protein, 9 aa, Homo sapiens
  Light chain CDR3
QQYGSSPWT

SEQ ID NO: 10159 - protein, 9 aa, Homo sapiens
  Light chain CDR3
QQYGRSPWT

SEQ ID NO: 10160 - protein, 9 aa, Homo sapiens
  Light chain CDR3
QQYNSYPYT

SEQ ID NO: 10161 - protein, 9 aa, Homo sapiens
  Light chain CDR3
QQYGSSPFT

SEQ ID NO: 10162 - protein, 9 aa, Homo sapiens
  Light chain CDR3
HQYGSSPFT

SEQ ID NO: 10163 - protein, 9 aa, Homo sapiens
  Light chain CDR3
QQYGSSPWT

SEQ ID NO: 10164 - protein, 9 aa, Homo sapiens
  Light chain CDR3
QQYKSYPYT

SEQ ID NO: 10165 - protein, 9 aa, Homo sapiens
  Light chain CDR3
QQYNSYPYT

SEQ ID NO: 10166 - protein, 9 aa, Homo sapiens
  Light chain CDR3
QQYGSSPFT

SEQ ID NO: 10167 - protein, 9 aa, Homo sapiens
  Light chain CDR3
HQSSSLPFT

SEQ ID NO: 10168 - protein, 9 aa, Homo sapiens
  Light chain CDR3
QKYDSAPFT

SEQ ID NO: 10169 - protein, 9 aa, Homo sapiens
  Light chain CDR3
QRTYSAPYT

SEQ ID NO: 10170 - protein, 9 aa, Homo sapiens
  Light chain CDR3
QRTYSAPYT

SEQ ID NO: 10171 - protein, 9 aa, Homo sapiens
  Light chain CDR3
QQYGSSPWT

SEQ ID NO: 10172 - protein, 9 aa, Homo sapiens
  Light chain CDR3
QQYGSSPFT

SEQ ID NO: 10173 - protein, 9 aa, Homo sapiens
  Light chain CDR3
QQYGTSPWT

SEQ ID NO: 10174 - protein, 9 aa, Homo sapiens
  Light chain CDR3
QQYKNYPYT

SEQ ID NO: 10175 - protein, 9 aa, Homo sapiens
  Light chain CDR3
QRTYNAPYT

SEQ ID NO: 10176 - protein, 9 aa, Homo sapiens
  Light chain CDR3
QQYKSYPYT

SEQ ID NO: 10177 - protein, 9 aa, Homo sapiens
  Light chain CDR3
QQYGSSPFT

SEQ ID NO: 10178 - protein, 9 aa, Homo sapiens
  Light chain CDR3
QRTYSAPYT

SEQ ID NO: 10179 - protein, 9 aa, Homo sapiens
  Light chain CDR3
QQLNNYPYT

SEQ ID NO: 10180 - protein, 9 aa, Homo sapiens
  Light chain CDR3
QQYGSSPWT

SEQ ID NO: 10181 - protein, 9 aa, Homo sapiens
  Light chain CDR3
QQYGSSPWT

SEQ ID NO: 10182 - protein, 9 aa, Homo sapiens
  Light chain CDR3
QQYKSYPYT

SEQ ID NO: 10183 - protein, 9 aa, Homo sapiens
  Light chain CDR3
QQYNSYPYT

SEQ ID NO: 10184 - protein, 9 aa, Homo sapiens
  Light chain CDR3
QQYGSSPWT

SEQ ID NO: 10185 - protein, 9 aa, Homo sapiens
  Light chain CDR3
QQYGSSPFT

SEQ ID NO: 10186 - protein, 9 aa, Homo sapiens
  Light chain CDR3
QQYKTYPYT

SEQ ID NO: 10187 - protein, 9 aa, Homo sapiens
  Light chain CDR3
QQYGRSPFT

SEQ ID NO: 10188 - protein, 9 aa, Homo sapiens
  Light chain CDR3
QRTYSAPYT

SEQ ID NO: 10189 - protein, 9 aa, Homo sapiens
  Light chain CDR3
QQYGSSPWT

SEQ ID NO: 10190 - protein, 9 aa, Homo sapiens
  Light chain CDR3
QQYGRSPFT

SEQ ID NO: 10191 - protein, 9 aa, Homo sapiens
  Light chain CDR3
LRYGTSPFT

SEQ ID NO: 10192 - protein, 9 aa, Homo sapiens
  Light chain CDR3
QQDYNLPFT

SEQ ID NO: 10193 - protein, 9 aa, Homo sapiens
  Light chain CDR3
QQYRSYPYT

SEQ ID NO: 10194 - protein, 9 aa, Homo sapiens
  Light chain CDR3
QQYSRSPWT

SEQ ID NO: 10195 - protein, 9 aa, Homo sapiens
  Light chain CDR3
QQYGSSPFT

SEQ ID NO: 10196 - protein, 9 aa, Homo sapiens
  Light chain CDR3
QQYGTSPWT

SEQ ID NO: 10197 - protein, 9 aa, Homo sapiens
  Light chain CDR3
QQYKSYPYT

SEQ ID NO: 10198 - protein, 9 aa, Homo sapiens
  Light chain CDR3
QQYKSYPYT

SEQ ID NO: 10199 - protein, 9 aa, Homo sapiens
  Light chain CDR3
QRTYSAPYT

SEQ ID NO: 10200 - protein, 9 aa, Homo sapiens
  Light chain CDR3
QQYGSSPFT

SEQ ID NO: 10201 - protein, 9 aa, Homo sapiens
  Light chain CDR3
QQLNNYPYT

SEQ ID NO: 10202 - protein, 9 aa, Homo sapiens
  Light chain CDR3
QQYGRSPWT

SEQ ID NO: 10203 - protein, 9 aa, Homo sapiens
  Light chain CDR3
QQYGSSPWT

SEQ ID NO: 10204 - protein, 9 aa, Homo sapiens
  Light chain CDR3
QQFGSSPFT

SEQ ID NO: 10205 - protein, 9 aa, Homo sapiens
  Light chain CDR3
QQYNSYPYT

SEQ ID NO: 10206 - protein, 9 aa, Homo sapiens
  Light chain CDR3
QQYNSYPYT

SEQ ID NO: 10207 - protein, 9 aa, Homo sapiens
  Light chain CDR3
QQYKNYPYT

SEQ ID NO: 10208 - protein, 9 aa, Homo sapiens
  Light chain CDR3
QQYNSYPYT

SEQ ID NO: 10209 - protein, 9 aa, Homo sapiens
  Light chain CDR3
LQDYNLPFT

SEQ ID NO: 10210 - protein, 9 aa, Homo sapiens
  Light chain CDR3
QQYKSYPFT

SEQ ID NO: 10211 - protein, 9 aa, Homo sapiens
  Light chain CDR3
QQYNSYPYT

SEQ ID NO: 10212 - protein, 9 aa, Homo sapiens
  Light chain CDR3
QQYKSYPYT

SEQ ID NO: 10213 - protein, 9 aa, Homo sapiens
  Light chain CDR3
QQYKSYPYT

SEQ ID NO: 10214 - protein, 9 aa, Homo sapiens
  Light chain CDR3
QQYRSYPYT

SEQ ID NO: 10215 - protein, 9 aa, Homo sapiens
  Light chain CDR3
QQLNNYPYT

SEQ ID NO: 10216 - protein, 9 aa, Homo sapiens
  Light chain CDR3
QQYKSYPYT

SEQ ID NO: 10217 - protein, 9 aa, Homo sapiens
  Light chain CDR3
QQDYNLPFT

SEQ ID NO: 10218 - protein, 9 aa, Homo sapiens
  Light chain CDR3
QQYKSYPYT

SEQ ID NO: 10219 - protein, 9 aa, Homo sapiens
  Light chain CDR3
QQYGRSPWT

SEQ ID NO: 10220 - protein, 9 aa, Homo sapiens
  Light chain CDR3
QQDYNLPFT

SEQ ID NO: 10221 - protein, 9 aa, Homo sapiens
  Light chain CDR3
QQYKSYPYT

SEQ ID NO: 10222 - protein, 9 aa, Homo sapiens
  Light chain CDR3
QQYGSSPWT

SEQ ID NO: 10223 - protein, 9 aa, Homo sapiens
  Light chain CDR3
QQYGISPFT

SEQ ID NO: 10224 - protein, 9 aa, Homo sapiens
  Light chain CDR3
QQFGSSPWT

SEQ ID NO: 10225 - protein, 9 aa, Homo sapiens
  Light chain CDR3
QQYGSSPFT

SEQ ID NO: 10226 - protein, 9 aa, Homo sapiens
  Light chain CDR3
QQYGSSPWT

SEQ ID NO: 10227 - protein, 9 aa, Homo sapiens
  Light chain CDR3
QQYGSSPFT

SEQ ID NO: 10228 - protein, 9 aa, Homo sapiens
  Light chain CDR3
QQYGNSPFT

SEQ ID NO: 10229 - protein, 9 aa, Homo sapiens
  Light chain CDR3
MQSLQTPPT

SEQ ID NO: 10230 - protein, 9 aa, Homo sapiens
  Light chain CDR3
QQYGRSPWT

SEQ ID NO: 10231 - protein, 9 aa, Homo sapiens
  Light chain CDR3
QQSYSIPLT

SEQ ID NO: 10232 - protein, 9 aa, Homo sapiens
  Light chain CDR3
MQSLQTPPT

SEQ ID NO: 10233 - protein, 9 aa, Homo sapiens
  Light chain CDR3
HQSSSLPFT

SEQ ID NO: 10234 - protein, 9 aa, Homo sapiens
  Light chain CDR3
QQYGISPFT

SEQ ID NO: 10235 - protein, 9 aa, Homo sapiens
  Light chain CDR3
QLYNSYPFT

SEQ ID NO: 10236 - protein, 9 aa, Homo sapiens
  Light chain CDR3
QQYGISPFT

SEQ ID NO: 10237 - protein, 9 aa, Homo sapiens
  Light chain CDR3
QQFGSSPFT

SEQ ID NO: 10238 - protein, 9 aa, Homo sapiens
  Light chain CDR3
QQYGSSPWT

SEQ ID NO: 10239 - protein, 9 aa, Homo sapiens
  Light chain CDR3
QQYGSSPFT

SEQ ID NO: 10240 - protein, 9 aa, Homo sapiens
  Light chain CDR3
QQDYNLPFT

SEQ ID NO: 10241 - protein, 9 aa, Homo sapiens
  Light chain CDR3
QQYGSSPFT

SEQ ID NO: 10242 - protein, 9 aa, Homo sapiens
  Light chain CDR3
QQYGSSPWT

SEQ ID NO: 10243 - protein, 9 aa, Homo sapiens
  Light chain CDR3
QQDYNLPFT

SEQ ID NO: 10244 - protein, 9 aa, Homo sapiens
  Light chain CDR3
QQYGSSPWT

SEQ ID NO: 10245 - protein, 9 aa, Homo sapiens
  Light chain CDR3
QHYGSSPWT

SEQ ID NO: 10246 - protein, 9 aa, Homo sapiens
  Light chain CDR3
QQYGSSPFT

SEQ ID NO: 10247 - protein, 9 aa, Homo sapiens
  Light chain CDR3
QQYGSSPWT

SEQ ID NO: 10248 - protein, 9 aa, Homo sapiens
  Light chain CDR3
QQFGSSPWT

SEQ ID NO: 10249 - protein, 9 aa, Homo sapiens
  Light chain CDR3
QQYGSSPFT

SEQ ID NO: 10250 - protein, 9 aa, Homo sapiens
  Light chain CDR3
QQYGSSPWA

SEQ ID NO: 10251 - protein, 9 aa, Homo sapiens
  Light chain CDR3
QQYGISPFT

SEQ ID NO: 10252 - protein, 9 aa, Homo sapiens
  Light chain CDR3
QQYGISPFT

SEQ ID NO: 10253 - protein, 9 aa, Homo sapiens
  Light chain CDR3
QQYGSSPFT

SEQ ID NO: 10254 - protein, 9 aa, Homo sapiens
  Light chain CDR3
QQLGSSPFT

SEQ ID NO: 10255 - protein, 9 aa, Homo sapiens
  Light chain CDR3
QQYGSSPFT

SEQ ID NO: 10256 - protein, 9 aa, Homo sapiens
  Light chain CDR3
MQALQTPLT

SEQ ID NO: 10257 - protein, 9 aa, Homo sapiens
  Light chain CDR3
QQYGSSPWT

SEQ ID NO: 10258 - protein, 9 aa, Homo sapiens
  Light chain CDR3
QQYGSSPWT

SEQ ID NO: 10259 - protein, 9 aa, Homo sapiens
  Light chain CDR3
QQYGSSPWT

SEQ ID NO: 10260 - protein, 9 aa, Homo sapiens
  Light chain CDR3
QQYGSSPFT

SEQ ID NO: 10261 - protein, 9 aa, Homo sapiens
  Light chain CDR3
QQYGSSPFT

SEQ ID NO: 10262 - protein, 9 aa, Homo sapiens
  Light chain CDR3
QQYGISPFT

SEQ ID NO: 10263 - protein, 9 aa, Homo sapiens
  Light chain CDR3
QQYGSSPWT

SEQ ID NO: 10264 - protein, 9 aa, Homo sapiens
  Light chain CDR3
QQYGSSPWT

SEQ ID NO: 10265 - protein, 9 aa, Homo sapiens
  Light chain CDR3
QHYGSSPWT

SEQ ID NO: 10266 - protein, 9 aa, Homo sapiens
  Light chain CDR3
QQYGSSPFT

SEQ ID NO: 10267 - protein, 9 aa, Homo sapiens
  Light chain CDR3
QHYGSSPWT

SEQ ID NO: 10268 - protein, 9 aa, Homo sapiens
  Light chain CDR3
QQYGSSPFT

SEQ ID NO: 10269 - protein, 9 aa, Homo sapiens
  Light chain CDR3
QQYGSSPFT

SEQ ID NO: 10270 - protein, 9 aa, Homo sapiens
  Light chain CDR3
QQYGSSPFT

SEQ ID NO: 10271 - protein, 9 aa, Homo sapiens
  Light chain CDR3
QQYGISPFT

SEQ ID NO: 10272 - protein, 9 aa, Homo sapiens
  Light chain CDR3
QQYGTSPFT

SEQ ID NO: 10273 - protein, 9 aa, Homo sapiens
  Light chain CDR3
QQYGSSPFT

SEQ ID NO: 10274 - protein, 9 aa, Homo sapiens
  Light chain CDR3
QQYGSSPFT

SEQ ID NO: 10275 - protein, 9 aa, Homo sapiens
  Light chain CDR3
QQYGSSPFT

SEQ ID NO: 10276 - protein, 9 aa, Homo sapiens
  Light chain CDR3
QQYGTSPFT

SEQ ID NO: 10277 - protein, 9 aa, Homo sapiens
  Light chain CDR3
QQYGSSPFT

SEQ ID NO: 10278 - protein, 9 aa, Homo sapiens
  Light chain CDR3
QQYGSSPFT

SEQ ID NO: 10279 - protein, 9 aa, Homo sapiens
  Light chain CDR3
QQYGSSPWT

SEQ ID NO: 10280 - protein, 9 aa, Homo sapiens
  Light chain CDR3
QQYGSSPFT

SEQ ID NO: 10281 - protein, 9 aa, Homo sapiens
  Light chain CDR3
QQYGRSPFT

SEQ ID NO: 10282 - protein, 9 aa, Homo sapiens
  Light chain CDR3
QQYGSSPFT

SEQ ID NO: 10283 - protein, 9 aa, Homo sapiens
  Light chain CDR3
QQYGSSPFT

SEQ ID NO: 10284 - protein, 9 aa, Homo sapiens
  Light chain CDR3
QQYGSSPFT

SEQ ID NO: 10285 - protein, 9 aa, Homo sapiens
  Light chain CDR3
QQYGSSPWT

SEQ ID NO: 10286 - protein, 9 aa, Homo sapiens
  Light chain CDR3
QQFGSSPFT

SEQ ID NO: 10287 - protein, 9 aa, Homo sapiens
  Light chain CDR3
QQYGSSPFT

SEQ ID NO: 10288 - protein, 9 aa, Homo sapiens
  Light chain CDR3
QQSYSTPLT

SEQ ID NO: 10289 - protein, 9 aa, Homo sapiens
  Light chain CDR3
QQYGSSPFT

SEQ ID NO: 10290 - protein, 9 aa, Homo sapiens
  Light chain CDR3
QQYNSYPYT

SEQ ID NO: 10291 - protein, 9 aa, Homo sapiens
  Light chain CDR3
QQYGTSPWT

SEQ ID NO: 10292 - protein, 9 aa, Homo sapiens
  Light chain CDR3
HQDYNLPYT

SEQ ID NO: 10293 - protein, 9 aa, Homo sapiens
  Light chain CDR3
QQYGSSPWT

SEQ ID NO: 10294 - protein, 9 aa, Homo sapiens
  Light chain CDR3
QQYGSSPFT

SEQ ID NO: 10295 - protein, 9 aa, Homo sapiens
  Light chain CDR3
QQYGSSPFT

SEQ ID NO: 10296 - protein, 9 aa, Homo sapiens
  Light chain CDR3
QQSYSTPLT

SEQ ID NO: 10297 - protein, 9 aa, Homo sapiens
  Light chain CDR3
QQYGISPFT

SEQ ID NO: 10298 - protein, 9 aa, Homo sapiens
  Light chain CDR3
QHYGSSPWT

SEQ ID NO: 10299 - protein, 9 aa, Homo sapiens
  Light chain CDR3
HQYYSTPYT

SEQ ID NO: 10300 - protein, 9 aa, Homo sapiens
  Light chain CDR3
QQDYNLPYT

SEQ ID NO: 10301 - protein, 9 aa, Homo sapiens
  Light chain CDR3
QQYCSTPYT

SEQ ID NO: 10302 - protein, 8 aa, Homo sapiens
  Light chain CDR3
HQSSSLPT

SEQ ID NO: 10303 - protein, 9 aa, Homo sapiens
  Light chain CDR3
MQALQTPIT

SEQ ID NO: 10304 - protein, 8 aa, Homo sapiens
  Light chain CDR3
MQSLQTIT

SEQ ID NO: 10305 - protein, 9 aa, Homo sapiens
  Light chain CDR3
QQYGSSPWT

SEQ ID NO: 10306 - protein, 9 aa, Homo sapiens
  Light chain CDR3
QKYNSAPWT

SEQ ID NO: 10307 - protein, 9 aa, Homo sapiens
  Light chain CDR3
QQYGSSPFT

SEQ ID NO: 10308 - protein, 9 aa, Homo sapiens
  Light chain CDR3
QHVYHLPWT

SEQ ID NO: 10309 - protein, 9 aa, Homo sapiens
  Light chain CDR3
QQYGSSPFT

SEQ ID NO: 10310 - protein, 9 aa, Homo sapiens
  Light chain CDR3
QQYGSSPFT

SEQ ID NO: 10311 - protein, 9 aa, Homo sapiens
  Light chain CDR3
QQYGSSPWT

SEQ ID NO: 10312 - protein, 9 aa, Homo sapiens
  Light chain CDR3
QQDYNLPLT

SEQ ID NO: 10313 - protein, 9 aa, Homo sapiens
  Light chain CDR3
QQYGSSPFT

SEQ ID NO: 10314 - protein, 9 aa, Homo sapiens
  Light chain CDR3
QQYGSSPFT

SEQ ID NO: 10315 - protein, 9 aa, Homo sapiens
  Light chain CDR3
QQAYNLPYT

SEQ ID NO: 10316 - protein, 9 aa, Homo sapiens
  Light chain CDR3
QQSYSTPLT

SEQ ID NO: 10317 - protein, 9 aa, Homo sapiens
  Light chain CDR3
QQYGSSPFT

SEQ ID NO: 10318 - protein, 9 aa, Homo sapiens
  Light chain CDR3
QQDYNLPFT

SEQ ID NO: 10319 - protein, 9 aa, Homo sapiens
  Light chain CDR3
QQYGSSPFT

SEQ ID NO: 10320 - protein, 9 aa, Homo sapiens
  Light chain CDR3
QQYGSSPFT

SEQ ID NO: 10321 - protein, 9 aa, Homo sapiens
  Light chain CDR3
LQHNSYPFT

SEQ ID NO: 10322 - protein, 9 aa, Homo sapiens
  Light chain CDR3
QQYGSSPFT

SEQ ID NO: 10323 - protein, 9 aa, Homo sapiens
  Light chain CDR3
QQYGISPFT

SEQ ID NO: 10324 - protein, 9 aa, Homo sapiens
  Light chain CDR3
QQYGTSPWT

SEQ ID NO: 10325 - protein, 9 aa, Homo sapiens
  Light chain CDR3
QQYGISPFT

SEQ ID NO: 10326 - protein, 9 aa, Homo sapiens
  Light chain CDR3
QQYGSSPFT

SEQ ID NO: 10327 - protein, 9 aa, Homo sapiens
  Light chain CDR3
QQDYKLPYT

SEQ ID NO: 10328 - protein, 9 aa, Homo sapiens
  Light chain CDR3
QQYGSSLWT

SEQ ID NO: 10329 - protein, 9 aa, Homo sapiens
  Light chain CDR3
QQYGTSPFT

SEQ ID NO: 10330 - protein, 9 aa, Homo sapiens
  Light chain CDR3
QQYGRSPFT

SEQ ID NO: 10331 - protein, 9 aa, Homo sapiens
  Light chain CDR3
QQYGSSPWT

SEQ ID NO: 10332 - protein, 9 aa, Homo sapiens
  Light chain CDR3
QQDYNLPFT

SEQ ID NO: 10333 - protein, 9 aa, Homo sapiens
  Light chain CDR3
QQYGVSPFT

SEQ ID NO: 10334 - protein, 9 aa, Homo sapiens
  Light chain CDR3
QQYGISPFT

SEQ ID NO: 10335 - protein, 9 aa, Homo sapiens
  Light chain CDR3
QQYGISPFT

SEQ ID NO: 10336 - protein, 9 aa, Homo sapiens
  Light chain CDR3
QQYGSSPFT

SEQ ID NO: 10337 - protein, 9 aa, Homo sapiens
  Light chain CDR3
QQYGTSPFT

SEQ ID NO: 10338 - protein, 9 aa, Homo sapiens
  Light chain CDR3
QQYGSSPFT

SEQ ID NO: 10339 - protein, 9 aa, Homo sapiens
  Light chain CDR3
QQYGSSPFT

SEQ ID NO: 10340 - protein, 9 aa, Homo sapiens
  Light chain CDR3
QQYGSSPFT

SEQ ID NO: 10341 - protein, 9 aa, Homo sapiens
  Light chain CDR3
QHYGSSPWT

SEQ ID NO: 10342 - protein, 9 aa, Homo sapiens
  Light chain CDR3
QQYGSSPFT

SEQ ID NO: 10343 - protein, 9 aa, Homo sapiens
  Light chain CDR3
QQYGTSPFT

SEQ ID NO: 10344 - protein, 9 aa, Homo sapiens
  Light chain CDR3
QQYGSSPFT

SEQ ID NO: 10345 - protein, 9 aa, Homo sapiens
  Light chain CDR3
MQTLQTPPT

SEQ ID NO: 10346 - protein, 9 aa, Homo sapiens
  Light chain CDR3
QQYGSSPFT

SEQ ID NO: 10347 - protein, 9 aa, Homo sapiens
  Light chain CDR3
QQYGISPFT

SEQ ID NO: 10348 - protein, 9 aa, Homo sapiens
  Light chain CDR3
QQYGSSPFT

SEQ ID NO: 10349 - protein, 9 aa, Homo sapiens
  Light chain CDR3
QQYGISPFT

SEQ ID NO: 10350 - protein, 9 aa, Homo sapiens
  Light chain CDR3
QQYGTSPFT

SEQ ID NO: 10351 - protein, 9 aa, Homo sapiens
  Light chain CDR3
QQYGISPFT

SEQ ID NO: 10352 - protein, 9 aa, Homo sapiens
  Light chain CDR3
QQYGISPFT

SEQ ID NO: 10353 - protein, 9 aa, Homo sapiens
  Light chain CDR3
QQYGTSPFT

SEQ ID NO: 10354 - protein, 9 aa, Homo sapiens
  Light chain CDR3
QQYGISPFT

SEQ ID NO: 10355 - protein, 9 aa, Homo sapiens
  Light chain CDR3
QQYGSSPFT

SEQ ID NO: 10356 - protein, 9 aa, Homo sapiens
  Light chain CDR3
QQYGISPFT

SEQ ID NO: 10357 - protein, 9 aa, Homo sapiens
  Light chain CDR3
QQYGISPFT

SEQ ID NO: 10358 - protein, 9 aa, Homo sapiens
  Light chain CDR3
QQYGSSPFT

SEQ ID NO: 10359 - protein, 9 aa, Homo sapiens
  Light chain CDR3
QQYGRSPFT

SEQ ID NO: 10360 - protein, 9 aa, Homo sapiens
  Light chain CDR3
QQYGSSPFT

SEQ ID NO: 10361 - protein, 9 aa, Homo sapiens
  Light chain CDR3
QQYGSSPWT

SEQ ID NO: 10362 - protein, 9 aa, Homo sapiens
  Light chain CDR3
HQSSSLPFT

SEQ ID NO: 10363 - protein, 9 aa, Homo sapiens
  Light chain CDR3
QQYGSSPFT

SEQ ID NO: 10364 - protein, 9 aa, Homo sapiens
  Light chain CDR3
LQHNSYPLT

SEQ ID NO: 10365 - protein, 9 aa, Homo sapiens
  Light chain CDR3
QQYGSSPFT

SEQ ID NO: 10366 - protein, 9 aa, Homo sapiens
  Light chain CDR3
QQYGSSPFT

SEQ ID NO: 10367 - protein, 9 aa, Homo sapiens
  Light chain CDR3
QQYGSSPWT

SEQ ID NO: 10368 - protein, 9 aa, Homo sapiens
  Light chain CDR3
QQYGRSPWT

SEQ ID NO: 10369 - protein, 9 aa, Homo sapiens
  Light chain CDR3
LQHNSYPLT

SEQ ID NO: 10370 - protein, 9 aa, Homo sapiens
  Light chain CDR3
QQYGSSPWT

SEQ ID NO: 10371 - protein, 9 aa, Homo sapiens
  Light chain CDR3
QQYGSSPFT

SEQ ID NO: 10372 - protein, 9 aa, Homo sapiens
  Light chain CDR3
QQYGGSPWT

SEQ ID NO: 10373 - protein, 9 aa, Homo sapiens
  Light chain CDR3
QQYGSSPFT

SEQ ID NO: 10374 - protein, 9 aa, Homo sapiens
  Light chain CDR3
QQYGSSPWT

SEQ ID NO: 10375 - protein, 9 aa, Homo sapiens
  Light chain CDR3
QQYGSSPWT

SEQ ID NO: 10376 - protein, 9 aa, Homo sapiens
  Light chain CDR3
QQSYSTPFT

SEQ ID NO: 10377 - protein, 9 aa, Homo sapiens
  Light chain CDR3
MQGTHWPIT

SEQ ID NO: 10378 - protein, 9 aa, Homo sapiens
  Light chain CDR3
QQYGPSPWT

SEQ ID NO: 10379 - protein, 9 aa, Homo sapiens
  Light chain CDR3
QQYGSSPFT

SEQ ID NO: 10380 - protein, 9 aa, Homo sapiens
  Light chain CDR3
MQTLQTPLT

SEQ ID NO: 10381 - protein, 9 aa, Homo sapiens
  Light chain CDR3
QQYGTSPWT

SEQ ID NO: 10382 - protein, 9 aa, Homo sapiens
  Light chain CDR3
QQSYRTPFT

SEQ ID NO: 10383 - protein, 9 aa, Homo sapiens
  Light chain CDR3
QQYGSSPWT

SEQ ID NO: 10384 - protein, 9 aa, Homo sapiens
  Light chain CDR3
QKYNSAPFT

SEQ ID NO: 10385 - protein, 9 aa, Homo sapiens
  Light chain CDR3
QQSYSTPFT

SEQ ID NO: 10386 - protein, 9 aa, Homo sapiens
  Light chain CDR3
QHYGSSPFT

SEQ ID NO: 10387 - protein, 9 aa, Homo sapiens
  Light chain CDR3
QKYNSAPYT

SEQ ID NO: 10388 - protein, 9 aa, Homo sapiens
  Light chain CDR3
QQSYRTPFT

SEQ ID NO: 10389 - protein, 9 aa, Homo sapiens
  Light chain CDR3
QQYGRSPFT

SEQ ID NO: 10390 - protein, 9 aa, Homo sapiens
  Light chain CDR3
QQSYSTPFT

SEQ ID NO: 10391 - protein, 9 aa, Homo sapiens
  Light chain CDR3
QQYGSSPWT

SEQ ID NO: 10392 - protein, 9 aa, Homo sapiens
  Light chain CDR3
QQYGSSPWT

SEQ ID NO: 10393 - protein, 9 aa, Homo sapiens
  Light chain CDR3
QKYNSAPLT

SEQ ID NO: 10394 - protein, 9 aa, Homo sapiens
  Light chain CDR3
QQYGRSPFT

SEQ ID NO: 10395 - protein, 9 aa, Homo sapiens
  Light chain CDR3
QQDYNLPFT

SEQ ID NO: 10396 - protein, 9 aa, Homo sapiens
  Light chain CDR3
QQYGTSPFT

SEQ ID NO: 10397 - protein, 9 aa, Homo sapiens
  Light chain CDR3
QQYGTSPFT

SEQ ID NO: 10398 - protein, 9 aa, Homo sapiens
  Light chain CDR3
QQYGSSPWT

SEQ ID NO: 10399 - protein, 9 aa, Homo sapiens
  Light chain CDR3
QQYGSSPFT

SEQ ID NO: 10400 - protein, 9 aa, Homo sapiens
  Light chain CDR3
QQLNSYPPT

SEQ ID NO: 10401 - protein, 9 aa, Homo sapiens
  Light chain CDR3
QQYGSSPFT

SEQ ID NO: 10402 - protein, 9 aa, Homo sapiens
  Light chain CDR3
HQSSSLPFT

SEQ ID NO: 10403 - protein, 9 aa, Homo sapiens
  Light chain CDR3
QQSYSTPFT

SEQ ID NO: 10404 - protein, 9 aa, Homo sapiens
  Light chain CDR3
QVYNSAPYT

SEQ ID NO: 10405 - protein, 9 aa, Homo sapiens
  Light chain CDR3
QQGYNLPFT

SEQ ID NO: 10406 - protein, 9 aa, Homo sapiens
  Light chain CDR3
QQYGSSPFT

SEQ ID NO: 10407 - protein, 10 aa, Homo sapiens
  Light chain CDR3
QKYNSAPPLT

SEQ ID NO: 10408 - protein, 9 aa, Homo sapiens
  Light chain CDR3
QQVYNLPWT

SEQ ID NO: 10409 - protein, 9 aa, Homo sapiens
  Light chain CDR3
QQDYNLPFT

SEQ ID NO: 10410 - protein, 9 aa, Homo sapiens
  Light chain CDR3
QQYGRSPFT

SEQ ID NO: 10411 - protein, 9 aa, Homo sapiens
  Light chain CDR3
QQYGRSPFT

SEQ ID NO: 10412 - protein, 9 aa, Homo sapiens
  Light chain CDR3
QQYGSSPFT

SEQ ID NO: 10413 - protein, 9 aa, Homo sapiens
  Light chain CDR3
QQYGRSPFT

SEQ ID NO: 10414 - protein, 9 aa, Homo sapiens
  Light chain CDR3
QQYGTSPYT

SEQ ID NO: 10415 - protein, 9 aa, Homo sapiens
  Light chain CDR3
QQSYRTPFT

SEQ ID NO: 10416 - protein, 9 aa, Homo sapiens
  Light chain CDR3
QQYGSSPWT

SEQ ID NO: 10417 - protein, 9 aa, Homo sapiens
  Light chain CDR3
QQYGSSPWT

SEQ ID NO: 10418 - protein, 9 aa, Homo sapiens
  Light chain CDR3
QQYGSSPWT

SEQ ID NO: 10419 - protein, 9 aa, Homo sapiens
  Light chain CDR3
QQDYNLPFT

SEQ ID NO: 10420 - protein, 9 aa, Homo sapiens
  Light chain CDR3
QQYGSSPFT

SEQ ID NO: 10421 - protein, 9 aa, Homo sapiens
  Light chain CDR3
QQDYNLPFT

SEQ ID NO: 10422 - protein, 9 aa, Homo sapiens
  Light chain CDR3
QEYSSAPWT

SEQ ID NO: 10423 - protein, 9 aa, Homo sapiens
  Light chain CDR3
QQYGSSPWT

SEQ ID NO: 10424 - protein, 9 aa, Homo sapiens
  Light chain CDR3
QQVYNLPFT

SEQ ID NO: 10425 - protein, 9 aa, Homo sapiens
  Light chain CDR3
QKYGSSPFT

SEQ ID NO: 10426 - protein, 10 aa, Homo sapiens
  Light chain CDR3
QQRSNWPPYT

SEQ ID NO: 10427 - protein, 9 aa, Homo sapiens
  Light chain CDR3
QQYGSSPFT

SEQ ID NO: 10428 - protein, 9 aa, Homo sapiens
  Light chain CDR3
QQYGSSPFT

SEQ ID NO: 10429 - protein, 9 aa, Homo sapiens
  Light chain CDR3
QQYGSSPFT

SEQ ID NO: 10430 - protein, 9 aa, Homo sapiens
  Light chain CDR3
QQYGSSPFT

SEQ ID NO: 10431 - protein, 9 aa, Homo sapiens
  Light chain CDR3
QQYGSSPWT

SEQ ID NO: 10432 - protein, 9 aa, Homo sapiens
  Light chain CDR3
HQDYNLPYT

SEQ ID NO: 10433 - protein, 9 aa, Homo sapiens
  Light chain CDR3
QQYGSSPWT

SEQ ID NO: 10434 - protein, 9 aa, Homo sapiens
  Light chain CDR3
QQYGSSPFT

SEQ ID NO: 10435 - protein, 9 aa, Homo sapiens
  Light chain CDR3
QQYGRSPFT

SEQ ID NO: 10436 - protein, 9 aa, Homo sapiens
  Light chain CDR3
QQYGSSPWT

SEQ ID NO: 10437 - protein, 9 aa, Homo sapiens
  Light chain CDR3
QQYGSSPFT

SEQ ID NO: 10438 - protein, 9 aa, Homo sapiens
  Light chain CDR3
QNYNSAPWT

SEQ ID NO: 10439 - protein, 9 aa, Homo sapiens
  Light chain CDR3
QQYGRSPWT

SEQ ID NO: 10440 - protein, 9 aa, Homo sapiens
  Light chain CDR3
QHYGSSPFT

SEQ ID NO: 10441 - protein, 9 aa, Homo sapiens
  Light chain CDR3
MQTLQTPLT

SEQ ID NO: 10442 - protein, 9 aa, Homo sapiens
  Light chain CDR3
QQYGTSPFT

SEQ ID NO: 10443 - protein, 9 aa, Homo sapiens
  Light chain CDR3
QQYGRSPWT

SEQ ID NO: 10444 - protein, 10 aa, Homo sapiens
  Light chain CDR3
QQYGSSSMYT

SEQ ID NO: 10445 - protein, 10 aa, Homo sapiens
  Light chain CDR3
QQYGSSTMYT

SEQ ID NO: 10446 - protein, 9 aa, Homo sapiens
  Light chain CDR3
QKYNSAPYT

SEQ ID NO: 10447 - protein, 9 aa, Homo sapiens
  Light chain CDR3
QQYGTSPFT

SEQ ID NO: 10448 - protein, 9 aa, Homo sapiens
  Light chain CDR3
QQYGSSPWT

SEQ ID NO: 10449 - protein, 9 aa, Homo sapiens
  Light chain CDR3
QQYGSSPWT

SEQ ID NO: 10450 - protein, 9 aa, Homo sapiens
  Light chain CDR3
QQYGSSPWT

SEQ ID NO: 10451 - protein, 9 aa, Homo sapiens
  Light chain CDR3
QQYGSSPWT

SEQ ID NO: 10452 - protein, 9 aa, Homo sapiens
  Light chain CDR3
QQYGTSPWT

SEQ ID NO: 10453 - protein, 9 aa, Homo sapiens
  Light chain CDR3
QQYGSSPFT

SEQ ID NO: 10454 - protein, 9 aa, Homo sapiens
  Light chain CDR3
QQYGSSPWT

SEQ ID NO: 10455 - protein, 9 aa, Homo sapiens
  Light chain CDR3
QQYGSSPWT

SEQ ID NO: 10456 - protein, 9 aa, Homo sapiens
  Light chain CDR3
QHYGSSPFT

SEQ ID NO: 10457 - protein, 10 aa, Homo sapiens
  Light chain CDR3
QQRSNWPPYT

SEQ ID NO: 10458 - protein, 9 aa, Homo sapiens
  Light chain CDR3
QQYGSSPWT

SEQ ID NO: 10459 - protein, 9 aa, Homo sapiens
  Light chain CDR3
QQYGSSPFT

SEQ ID NO: 10460 - protein, 9 aa, Homo sapiens
  Light chain CDR3
QQYGSSPWT

SEQ ID NO: 10461 - protein, 9 aa, Homo sapiens
  Light chain CDR3
QQSYTTPLT

SEQ ID NO: 10462 - protein, 9 aa, Homo sapiens
  Light chain CDR3
QQYGSSPWT

SEQ ID NO: 10463 - protein, 9 aa, Homo sapiens
  Light chain CDR3
QQYGTSPWT

SEQ ID NO: 10464 - protein, 9 aa, Homo sapiens
  Light chain CDR3
QQYGRSPFT

SEQ ID NO: 10465 - protein, 9 aa, Homo sapiens
  Light chain CDR3
QQYGNSPWT

SEQ ID NO: 10466 - protein, 9 aa, Homo sapiens
  Light chain CDR3
QQYGSSPWT

SEQ ID NO: 10467 - protein, 9 aa, Homo sapiens
  Light chain CDR3
QQYGSSPWT

SEQ ID NO: 10468 - protein, 9 aa, Homo sapiens
  Light chain CDR3
QQYGTSPFT

SEQ ID NO: 10469 - protein, 9 aa, Homo sapiens
  Light chain CDR3
QQYGSSPFT

SEQ ID NO: 10470 - protein, 9 aa, Homo sapiens
  Light chain CDR3
QHYGSSPFT

SEQ ID NO: 10471 - protein, 9 aa, Homo sapiens
  Light chain CDR3
QQDYNLPLT

SEQ ID NO: 10472 - protein, 9 aa, Homo sapiens
  Light chain CDR3
QQYGRSPFT

SEQ ID NO: 10473 - protein, 9 aa, Homo sapiens
  Light chain CDR3
QQYGRSPFT

SEQ ID NO: 10474 - protein, 9 aa, Homo sapiens
  Light chain CDR3
QQYGSSPWT

SEQ ID NO: 10475 - protein, 9 aa, Homo sapiens
  Light chain CDR3
QQYGRSPFT

SEQ ID NO: 10476 - protein, 9 aa, Homo sapiens
  Light chain CDR3
QHYGSSPWT

SEQ ID NO: 10477 - protein, 9 aa, Homo sapiens
  Light chain CDR3
QQYGTSPFT

SEQ ID NO: 10478 - protein, 9 aa, Homo sapiens
  Light chain CDR3
QQYGRSPFT

SEQ ID NO: 10479 - protein, 9 aa, Homo sapiens
  Light chain CDR3
QQYGRSPWT

SEQ ID NO: 10480 - protein, 8 aa, Homo sapiens
  Heavy chain CDR1
GGSISSYY

SEQ ID NO: 10481 - protein, 10 aa, Homo sapiens
  Heavy chain CDR1
GGSISSSSYY

SEQ ID NO: 10482 - protein, 10 aa, Homo sapiens
  Heavy chain CDR1
GGSISSSSYY

SEQ ID NO: 10483 - protein, 10 aa, Homo sapiens
  Heavy chain CDR1
GGSISSSSYY

SEQ ID NO: 10484 - protein, 8 aa, Homo sapiens
  Heavy chain CDR1
GFTFSDYY

SEQ ID NO: 10485 - protein, 10 aa, Homo sapiens
  Heavy chain CDR1
GGSISSSSYY

SEQ ID NO: 10486 - protein, 10 aa, Homo sapiens
  Heavy chain CDR1
GGSISSSSYY

SEQ ID NO: 10487 - protein, 8 aa, Homo sapiens
  Heavy chain CDR1
GGSISSYY

SEQ ID NO: 10488 - protein, 8 aa, Homo sapiens
  Heavy chain CDR1
GFTFSNAW

SEQ ID NO: 10489 - protein, 8 aa, Homo sapiens
  Heavy chain CDR1
GYTFTSYG

SEQ ID NO: 10490 - protein, 10 aa, Homo sapiens
  Heavy chain CDR1
GGSISSSSYY

SEQ ID NO: 10491 - protein, 8 aa, Homo sapiens
  Heavy chain CDR1
GFTFDDYG

SEQ ID NO: 10492 - protein, 10 aa, Homo sapiens
  Heavy chain CDR1
GGSISSSSYY

SEQ ID NO: 10493 - protein, 8 aa, Homo sapiens
  Heavy chain CDR1
GFTFDDYG

SEQ ID NO: 10494 - protein, 10 aa, Homo sapiens
  Heavy chain CDR1
GGSISSSSYY

SEQ ID NO: 10495 - protein, 10 aa, Homo sapiens
  Heavy chain CDR1
GGSISSSSYY

SEQ ID NO: 10496 - protein, 8 aa, Homo sapiens
  Heavy chain CDR1
GFTFSSYG

SEQ ID NO: 10497 - protein, 8 aa, Homo sapiens
  Heavy chain CDR1
GFTFSNAW

SEQ ID NO: 10498 - protein, 10 aa, Homo sapiens
  Heavy chain CDR1
GGSISSSSYY

SEQ ID NO: 10499 - protein, 8 aa, Homo sapiens
  Heavy chain CDR1
GGSISSYY

SEQ ID NO: 10500 - protein, 8 aa, Homo sapiens
  Heavy chain CDR1
GGSISSYY

SEQ ID NO: 10501 - protein, 8 aa, Homo sapiens
  Heavy chain CDR1
GYTFTSYG

SEQ ID NO: 10502 - protein, 8 aa, Homo sapiens
  Heavy chain CDR1
GFTFSNAW

SEQ ID NO: 10503 - protein, 8 aa, Homo sapiens
  Heavy chain CDR1
GGSISSYY

SEQ ID NO: 10504 - protein, 8 aa, Homo sapiens
  Heavy chain CDR1
GYTFTSYG

SEQ ID NO: 10505 - protein, 8 aa, Homo sapiens
  Heavy chain CDR1
GGSISSYY

SEQ ID NO: 10506 - protein, 8 aa, Homo sapiens
  Heavy chain CDR1
GFTFDDYG

SEQ ID NO: 10507 - protein, 8 aa, Homo sapiens
  Heavy chain CDR1
GFTFSSYG

SEQ ID NO: 10508 - protein, 8 aa, Homo sapiens
  Heavy chain CDR1
GFTFDDYG

SEQ ID NO: 10509 - protein, 8 aa, Homo sapiens
  Heavy chain CDR1
GGSISSYY

SEQ ID NO: 10510 - protein, 8 aa, Homo sapiens
  Heavy chain CDR1
GGSISSYY

SEQ ID NO: 10511 - protein, 8 aa, Homo sapiens
  Heavy chain CDR1
GYTFTSYG

SEQ ID NO: 10512 - protein, 8 aa, Homo sapiens
  Heavy chain CDR1
GGSISSYY

SEQ ID NO: 10513 - protein, 8 aa, Homo sapiens
  Heavy chain CDR1
GGSISSYY

SEQ ID NO: 10514 - protein, 8 aa, Homo sapiens
  Heavy chain CDR1
GFTFNNYG

SEQ ID NO: 10515 - protein, 8 aa, Homo sapiens
  Heavy chain CDR1
GYTFTSYG

SEQ ID NO: 10516 - protein, 10 aa, Homo sapiens
  Heavy chain CDR1
GGSISSSSYY

SEQ ID NO: 10517 - protein, 8 aa, Homo sapiens
  Heavy chain CDR1
GGSISSYY

SEQ ID NO: 10518 - protein, 8 aa, Homo sapiens
  Heavy chain CDR1
GFTFSNAW

SEQ ID NO: 10519 - protein, 8 aa, Homo sapiens
  Heavy chain CDR1
GFTFDDYG

SEQ ID NO: 10520 - protein, 10 aa, Homo sapiens
  Heavy chain CDR1
GGSISSSSYY

SEQ ID NO: 10521 - protein, 10 aa, Homo sapiens
  Heavy chain CDR1
GGSISSSSYY

SEQ ID NO: 10522 - protein, 8 aa, Homo sapiens
  Heavy chain CDR1
GGSISSYY

SEQ ID NO: 10523 - protein, 10 aa, Homo sapiens
  Heavy chain CDR1
GGSISSSSYY

SEQ ID NO: 10524 - protein, 8 aa, Homo sapiens
  Heavy chain CDR1
GFTFDDYG

SEQ ID NO: 10525 - protein, 8 aa, Homo sapiens
  Heavy chain CDR1
GFTFDDYG

SEQ ID NO: 10526 - protein, 8 aa, Homo sapiens
  Heavy chain CDR1
GFTFSSYG

SEQ ID NO: 10527 - protein, 8 aa, Homo sapiens
  Heavy chain CDR1
GFTFNSYG

SEQ ID NO: 10528 - protein, 8 aa, Homo sapiens
  Heavy chain CDR1
GFTFSSYG

SEQ ID NO: 10529 - protein, 8 aa, Homo sapiens
  Heavy chain CDR1
GFTLSSYG

SEQ ID NO: 10530 - protein, 10 aa, Homo sapiens
  Heavy chain CDR1
GGSISSNSYY

SEQ ID NO: 10531 - protein, 8 aa, Homo sapiens
  Heavy chain CDR1
GFTFSTYG

SEQ ID NO: 10532 - protein, 8 aa, Homo sapiens
  Heavy chain CDR1
GFTFSSHG

SEQ ID NO: 10533 - protein, 8 aa, Homo sapiens
  Heavy chain CDR1
GFTFSSYG

SEQ ID NO: 10534 - protein, 8 aa, Homo sapiens
  Heavy chain CDR1
GFTFNSYG

SEQ ID NO: 10535 - protein, 8 aa, Homo sapiens
  Heavy chain CDR1
GFTLSRYG

SEQ ID NO: 10536 - protein, 8 aa, Homo sapiens
  Heavy chain CDR1
GFTFRSFG

SEQ ID NO: 10537 - protein, 8 aa, Homo sapiens
  Heavy chain CDR1
GFTFSSYG

SEQ ID NO: 10538 - protein, 8 aa, Homo sapiens
  Heavy chain CDR1
GFTFSRYG

SEQ ID NO: 10539 - protein, 8 aa, Homo sapiens
  Heavy chain CDR1
GFTFSTYG

SEQ ID NO: 10540 - protein, 8 aa, Homo sapiens
  Heavy chain CDR1
GFTFSSYG

SEQ ID NO: 10541 - protein, 8 aa, Homo sapiens
  Heavy chain CDR1
GFTFSSYG

SEQ ID NO: 10542 - protein, 8 aa, Homo sapiens
  Heavy chain CDR1
GFTFSSYG

SEQ ID NO: 10543 - protein, 8 aa, Homo sapiens
  Heavy chain CDR1
GFTFSRFG

SEQ ID NO: 10544 - protein, 8 aa, Homo sapiens
  Heavy chain CDR1
GFTLSRYG

SEQ ID NO: 10545 - protein, 8 aa, Homo sapiens
  Heavy chain CDR1
GFTFSSYG

SEQ ID NO: 10546 - protein, 8 aa, Homo sapiens
  Heavy chain CDR1
GFTFSNYC

SEQ ID NO: 10547 - protein, 8 aa, Homo sapiens
  Heavy chain CDR1
GFTFSSYG

SEQ ID NO: 10548 - protein, 8 aa, Homo sapiens
  Heavy chain CDR1
GFTFNSYG

SEQ ID NO: 10549 - protein, 8 aa, Homo sapiens
  Heavy chain CDR1
GFTFNSYG

SEQ ID NO: 10550 - protein, 8 aa, Homo sapiens
  Heavy chain CDR1
GFTLSSYG

SEQ ID NO: 10551 - protein, 8 aa, Homo sapiens
  Heavy chain CDR1
GFTFNSYG

SEQ ID NO: 10552 - protein, 8 aa, Homo sapiens
  Heavy chain CDR1
GFTFSSYG

SEQ ID NO: 10553 - protein, 8 aa, Homo sapiens
  Heavy chain CDR1
GFTFSRFG

SEQ ID NO: 10554 - protein, 8 aa, Homo sapiens
  Heavy chain CDR1
GFTLSSYG

SEQ ID NO: 10555 - protein, 8 aa, Homo sapiens
  Heavy chain CDR1
GFTFSSYG

SEQ ID NO: 10556 - protein, 8 aa, Homo sapiens
  Heavy chain CDR1
GFTFSSYG

SEQ ID NO: 10557 - protein, 8 aa, Homo sapiens
  Heavy chain CDR1
GFTFRSFG

SEQ ID NO: 10558 - protein, 8 aa, Homo sapiens
  Heavy chain CDR1
GFTFNSYG

SEQ ID NO: 10559 - protein, 8 aa, Homo sapiens
  Heavy chain CDR1
GFTFSSYG

SEQ ID NO: 10560 - protein, 8 aa, Homo sapiens
  Heavy chain CDR1
GFTFSSYG

SEQ ID NO: 10561 - protein, 8 aa, Homo sapiens
  Heavy chain CDR1
GFTFSSYG

SEQ ID NO: 10562 - protein, 8 aa, Homo sapiens
  Heavy chain CDR1
GFTFSSYG

SEQ ID NO: 10563 - protein, 8 aa, Homo sapiens
  Heavy chain CDR1
GITFSSYG

SEQ ID NO: 10564 - protein, 8 aa, Homo sapiens
  Heavy chain CDR1
GFTFSSYG

SEQ ID NO: 10565 - protein, 8 aa, Homo sapiens
  Heavy chain CDR1
GFTFSSYG

SEQ ID NO: 10566 - protein, 8 aa, Homo sapiens
  Heavy chain CDR1
GFTFSSYG

SEQ ID NO: 10567 - protein, 10 aa, Homo sapiens
  Heavy chain CDR1
GGSISSSSYY

SEQ ID NO: 10568 - protein, 10 aa, Homo sapiens
  Heavy chain CDR1
GGSISSSSYY

SEQ ID NO: 10569 - protein, 8 aa, Homo sapiens
  Heavy chain CDR1
GITFSSYG

SEQ ID NO: 10570 - protein, 8 aa, Homo sapiens
  Heavy chain CDR1
GVTLSSYG

SEQ ID NO: 10571 - protein, 8 aa, Homo sapiens
  Heavy chain CDR1
GFTFSSYG

SEQ ID NO: 10572 - protein, 10 aa, Homo sapiens
  Heavy chain CDR1
GGSISSSSYY

SEQ ID NO: 10573 - protein, 8 aa, Homo sapiens
  Heavy chain CDR1
GFTFSSYG

SEQ ID NO: 10574 - protein, 8 aa, Homo sapiens
  Heavy chain CDR1
GFTFSSYG

SEQ ID NO: 10575 - protein, 10 aa, Homo sapiens
  Heavy chain CDR1
GGSISSSSYY

SEQ ID NO: 10576 - protein, 8 aa, Homo sapiens
  Heavy chain CDR1
GFTFSSYG

SEQ ID NO: 10577 - protein, 8 aa, Homo sapiens
  Heavy chain CDR1
GFTFSSYG

SEQ ID NO: 10578 - protein, 10 aa, Homo sapiens
  Heavy chain CDR1
GGSISSSSYY

SEQ ID NO: 10579 - protein, 8 aa, Homo sapiens
  Heavy chain CDR1
GITFSSYG

SEQ ID NO: 10580 - protein, 8 aa, Homo sapiens
  Heavy chain CDR1
GFTFSSYG

SEQ ID NO: 10581 - protein, 8 aa, Homo sapiens
  Heavy chain CDR1
GFTFSSYG

SEQ ID NO: 10582 - protein, 8 aa, Homo sapiens
  Heavy chain CDR1
GFTFSSYN

SEQ ID NO: 10583 - protein, 10 aa, Homo sapiens
  Heavy chain CDR1
GGSISSSSYY

SEQ ID NO: 10584 - protein, 10 aa, Homo sapiens
  Heavy chain CDR1
GGSISSSSYY

SEQ ID NO: 10585 - protein, 8 aa, Homo sapiens
  Heavy chain CDR1
GFTFSSYG

SEQ ID NO: 10586 - protein, 8 aa, Homo sapiens
  Heavy chain CDR1
GFTFGDYV

SEQ ID NO: 10587 - protein, 8 aa, Homo sapiens
  Heavy chain CDR1
GGSISSYY

SEQ ID NO: 10588 - protein, 10 aa, Homo sapiens
  Heavy chain CDR1
GGSISSSSYY

SEQ ID NO: 10589 - protein, 10 aa, Homo sapiens
  Heavy chain CDR1
GGSISSSSYY

SEQ ID NO: 10590 - protein, 8 aa, Homo sapiens
  Heavy chain CDR1
GFTFSSYG

SEQ ID NO: 10591 - protein, 10 aa, Homo sapiens
  Heavy chain CDR1
GGSISSSSYY

SEQ ID NO: 10592 - protein, 10 aa, Homo sapiens
  Heavy chain CDR1
GGSISSSSYY

SEQ ID NO: 10593 - protein, 8 aa, Homo sapiens
  Heavy chain CDR1
GFTFSSYG

SEQ ID NO: 10594 - protein, 8 aa, Homo sapiens
  Heavy chain CDR1
GFTFSSYG

SEQ ID NO: 10595 - protein, 8 aa, Homo sapiens
  Heavy chain CDR1
GFTFSSYG

SEQ ID NO: 10596 - protein, 8 aa, Homo sapiens
  Heavy chain CDR1
GFTFSSYG

SEQ ID NO: 10597 - protein, 8 aa, Homo sapiens
  Heavy chain CDR1
GFTFSSYG

SEQ ID NO: 10598 - protein, 10 aa, Homo sapiens
  Heavy chain CDR1
GGSISSSSYY

SEQ ID NO: 10599 - protein, 8 aa, Homo sapiens
  Heavy chain CDR1
GFTFSSYG

SEQ ID NO: 10600 - protein, 8 aa, Homo sapiens
  Heavy chain CDR1
GFTFSSYG

SEQ ID NO: 10601 - protein, 8 aa, Homo sapiens
  Heavy chain CDR1
GFTFSSYG

SEQ ID NO: 10602 - protein, 10 aa, Homo sapiens
  Heavy chain CDR1
GGSISSSSYY

SEQ ID NO: 10603 - protein, 8 aa, Homo sapiens
  Heavy chain CDR1
GFTFSSYG

SEQ ID NO: 10604 - protein, 8 aa, Homo sapiens
  Heavy chain CDR1
GFTFSSYG

SEQ ID NO: 10605 - protein, 10 aa, Homo sapiens
  Heavy chain CDR1
GGSISSSSYY

SEQ ID NO: 10606 - protein, 10 aa, Homo sapiens
  Heavy chain CDR1
GGSISSSSYY

SEQ ID NO: 10607 - protein, 8 aa, Homo sapiens
  Heavy chain CDR1
GFTFSSYG

SEQ ID NO: 10608 - protein, 10 aa, Homo sapiens
  Heavy chain CDR1
GGSISSSSYY

SEQ ID NO: 10609 - protein, 8 aa, Homo sapiens
  Heavy chain CDR1
GFTFSSYG

SEQ ID NO: 10610 - protein, 8 aa, Homo sapiens
  Heavy chain CDR1
GFTFSSYG

SEQ ID NO: 10611 - protein, 8 aa, Homo sapiens
  Heavy chain CDR1
GFTFSSYG

SEQ ID NO: 10612 - protein, 8 aa, Homo sapiens
  Heavy chain CDR1
GFTFDDYG

SEQ ID NO: 10613 - protein, 8 aa, Homo sapiens
  Heavy chain CDR1
GFTFDDYG

SEQ ID NO: 10614 - protein, 8 aa, Homo sapiens
  Heavy chain CDR1
GYTFTSYG

SEQ ID NO: 10615 - protein, 8 aa, Homo sapiens
  Heavy chain CDR1
GFAFDDFG

SEQ ID NO: 10616 - protein, 8 aa, Homo sapiens
  Heavy chain CDR1
GYTFTSYG

SEQ ID NO: 10617 - protein, 8 aa, Homo sapiens
  Heavy chain CDR1
GYTFTSYG

SEQ ID NO: 10618 - protein, 8 aa, Homo sapiens
  Heavy chain CDR1
GFTFSSHG

SEQ ID NO: 10619 - protein, 8 aa, Homo sapiens
  Heavy chain CDR1
GFTFSSYG

SEQ ID NO: 10620 - protein, 8 aa, Homo sapiens
  Heavy chain CDR1
GYTFTSYY

SEQ ID NO: 10621 - protein, 8 aa, Homo sapiens
  Heavy chain CDR1
GFTFRGYG

SEQ ID NO: 10622 - protein, 8 aa, Homo sapiens
  Heavy chain CDR1
GFTFSSYG

SEQ ID NO: 10623 - protein, 8 aa, Homo sapiens
  Heavy chain CDR1
GYTFTSYY

SEQ ID NO: 10624 - protein, 8 aa, Homo sapiens
  Heavy chain CDR1
GFTFSSYG

SEQ ID NO: 10625 - protein, 8 aa, Homo sapiens
  Heavy chain CDR1
GFTFSSYG

SEQ ID NO: 10626 - protein, 8 aa, Homo sapiens
  Heavy chain CDR1
GFTFNSYG

SEQ ID NO: 10627 - protein, 8 aa, Homo sapiens
  Heavy chain CDR1
GFTFSNYG

SEQ ID NO: 10628 - protein, 8 aa, Homo sapiens
  Heavy chain CDR1
GYTFTNYG

SEQ ID NO: 10629 - protein, 8 aa, Homo sapiens
  Heavy chain CDR1
GFTFSSYG

SEQ ID NO: 10630 - protein, 8 aa, Homo sapiens
  Heavy chain CDR1
GYTFTSYG

SEQ ID NO: 10631 - protein, 8 aa, Homo sapiens
  Heavy chain CDR1
GYTFTNYG

SEQ ID NO: 10632 - protein, 8 aa, Homo sapiens
  Heavy chain CDR1
GFTFSSYG

SEQ ID NO: 10633 - protein, 8 aa, Homo sapiens
  Heavy chain CDR1
GFSFDDFG

SEQ ID NO: 10634 - protein, 8 aa, Homo sapiens
  Heavy chain CDR1
GFTFDDYG

SEQ ID NO: 10635 - protein, 8 aa, Homo sapiens
  Heavy chain CDR1
GFTFSYAW

SEQ ID NO: 10636 - protein, 8 aa, Homo sapiens
  Heavy chain CDR1
GFTFRGYG

SEQ ID NO: 10637 - protein, 8 aa, Homo sapiens
  Heavy chain CDR1
GFTFSSYG

SEQ ID NO: 10638 - protein, 8 aa, Homo sapiens
  Heavy chain CDR1
GFTFRGYG

SEQ ID NO: 10639 - protein, 8 aa, Homo sapiens
  Heavy chain CDR1
GFSFDDYG

SEQ ID NO: 10640 - protein, 8 aa, Homo sapiens
  Heavy chain CDR1
GFTFRGYG

SEQ ID NO: 10641 - protein, 8 aa, Homo sapiens
  Heavy chain CDR1
GFTFSSFG

SEQ ID NO: 10642 - protein, 8 aa, Homo sapiens
  Heavy chain CDR1
GFTFRGYG

SEQ ID NO: 10643 - protein, 8 aa, Homo sapiens
  Heavy chain CDR1
GFTFSSYG

SEQ ID NO: 10644 - protein, 8 aa, Homo sapiens
  Heavy chain CDR1
GFMFSSYG

SEQ ID NO: 10645 - protein, 8 aa, Homo sapiens
  Heavy chain CDR1
GFTFSSYG

SEQ ID NO: 10646 - protein, 8 aa, Homo sapiens
  Heavy chain CDR1
GFTFSSYG

SEQ ID NO: 10647 - protein, 8 aa, Homo sapiens
  Heavy chain CDR1
GFTFSSYG

SEQ ID NO: 10648 - protein, 8 aa, Homo sapiens
  Heavy chain CDR1
GFTFDDYG

SEQ ID NO: 10649 - protein, 8 aa, Homo sapiens
  Heavy chain CDR1
GYTFTSYG

SEQ ID NO: 10650 - protein, 8 aa, Homo sapiens
  Heavy chain CDR1
GFTFDDYG

SEQ ID NO: 10651 - protein, 8 aa, Homo sapiens
  Heavy chain CDR1
GFTFSSYG

SEQ ID NO: 10652 - protein, 8 aa, Homo sapiens
  Heavy chain CDR1
GFTFSSYG

SEQ ID NO: 10653 - protein, 8 aa, Homo sapiens
  Heavy chain CDR1
GYTFTSYG

SEQ ID NO: 10654 - protein, 8 aa, Homo sapiens
  Heavy chain CDR1
GFTFSSYG

SEQ ID NO: 10655 - protein, 8 aa, Homo sapiens
  Heavy chain CDR1
GFTFSSYG

SEQ ID NO: 10656 - protein, 8 aa, Homo sapiens
  Heavy chain CDR1
GFTFADYG

SEQ ID NO: 10657 - protein, 8 aa, Homo sapiens
  Heavy chain CDR1
GFTLSSYG

SEQ ID NO: 10658 - protein, 8 aa, Homo sapiens
  Heavy chain CDR1
GFTFSSYG

SEQ ID NO: 10659 - protein, 8 aa, Homo sapiens
  Heavy chain CDR1
GFTFSSYG

SEQ ID NO: 10660 - protein, 8 aa, Homo sapiens
  Heavy chain CDR1
GFTFDDYG

SEQ ID NO: 10661 - protein, 8 aa, Homo sapiens
  Heavy chain CDR1
GFTFDDYG

SEQ ID NO: 10662 - protein, 8 aa, Homo sapiens
  Heavy chain CDR1
GFTFSNHG

SEQ ID NO: 10663 - protein, 8 aa, Homo sapiens
  Heavy chain CDR1
GYTFTSYG

SEQ ID NO: 10664 - protein, 8 aa, Homo sapiens
  Heavy chain CDR1
GFTFSYAW

SEQ ID NO: 10665 - protein, 8 aa, Homo sapiens
  Heavy chain CDR1
GYTFTSYY

SEQ ID NO: 10666 - protein, 8 aa, Homo sapiens
  Heavy chain CDR1
GYTFTSYY

SEQ ID NO: 10667 - protein, 8 aa, Homo sapiens
  Heavy chain CDR1
GYTFTSYG

SEQ ID NO: 10668 - protein, 8 aa, Homo sapiens
  Heavy chain CDR1
GFTFSSYG

SEQ ID NO: 10669 - protein, 8 aa, Homo sapiens
  Heavy chain CDR1
GFTFSSYG

SEQ ID NO: 10670 - protein, 8 aa, Homo sapiens
  Heavy chain CDR1
GFAFDDFG

SEQ ID NO: 10671 - protein, 8 aa, Homo sapiens
  Heavy chain CDR1
GYTFTSYY

SEQ ID NO: 10672 - protein, 8 aa, Homo sapiens
  Heavy chain CDR1
GFTFDDYG

SEQ ID NO: 10673 - protein, 8 aa, Homo sapiens
  Heavy chain CDR1
GYTFTSYG

SEQ ID NO: 10674 - protein, 8 aa, Homo sapiens
  Heavy chain CDR1
GFTFTSYY

SEQ ID NO: 10675 - protein, 8 aa, Homo sapiens
  Heavy chain CDR1
GFTFRGYG

SEQ ID NO: 10676 - protein, 8 aa, Homo sapiens
  Heavy chain CDR1
GFTFSSYG

SEQ ID NO: 10677 - protein, 8 aa, Homo sapiens
  Heavy chain CDR1
GFTFSSYG

SEQ ID NO: 10678 - protein, 8 aa, Homo sapiens
  Heavy chain CDR1
GFTFDDYG

SEQ ID NO: 10679 - protein, 8 aa, Homo sapiens
  Heavy chain CDR1
GFAFDDFG

SEQ ID NO: 10680 - protein, 8 aa, Homo sapiens
  Heavy chain CDR1
GFMFSSYG

SEQ ID NO: 10681 - protein, 8 aa, Homo sapiens
  Heavy chain CDR1
GFTLSSHG

SEQ ID NO: 10682 - protein, 8 aa, Homo sapiens
  Heavy chain CDR1
GFTFDDYG

SEQ ID NO: 10683 - protein, 8 aa, Homo sapiens
  Heavy chain CDR1
GFTFSSHG

SEQ ID NO: 10684 - protein, 8 aa, Homo sapiens
  Heavy chain CDR1
GYTFTSYY

SEQ ID NO: 10685 - protein, 8 aa, Homo sapiens
  Heavy chain CDR1
GFTFSSYG

SEQ ID NO: 10686 - protein, 8 aa, Homo sapiens
  Heavy chain CDR1
GFTFSSHG

SEQ ID NO: 10687 - protein, 8 aa, Homo sapiens
  Heavy chain CDR1
GFTFSSYG

SEQ ID NO: 10688 - protein, 8 aa, Homo sapiens
  Heavy chain CDR1
GYTFTNYG

SEQ ID NO: 10689 - protein, 8 aa, Homo sapiens
  Heavy chain CDR1
GFAFDDFG

SEQ ID NO: 10690 - protein, 8 aa, Homo sapiens
  Heavy chain CDR1
GYTFTSYG

SEQ ID NO: 10691 - protein, 8 aa, Homo sapiens
  Heavy chain CDR1
GFTFSSYG

SEQ ID NO: 10692 - protein, 8 aa, Homo sapiens
  Heavy chain CDR1
GFIFSSYG

SEQ ID NO: 10693 - protein, 8 aa, Homo sapiens
  Heavy chain CDR1
GFIFEDYG

SEQ ID NO: 10694 - protein, 8 aa, Homo sapiens
  Heavy chain CDR1
GFTFDDYG

SEQ ID NO: 10695 - protein, 8 aa, Homo sapiens
  Heavy chain CDR1
GYTFTSYY

SEQ ID NO: 10696 - protein, 8 aa, Homo sapiens
  Heavy chain CDR1
GFTFSSYG

SEQ ID NO: 10697 - protein, 8 aa, Homo sapiens
  Heavy chain CDR1
GFTFRGYG

SEQ ID NO: 10698 - protein, 8 aa, Homo sapiens
  Heavy chain CDR1
GFTFSNFG

SEQ ID NO: 10699 - protein, 8 aa, Homo sapiens
  Heavy chain CDR1
GYTFTSYG

SEQ ID NO: 10700 - protein, 8 aa, Homo sapiens
  Heavy chain CDR1
GFTFSSYG

SEQ ID NO: 10701 - protein, 8 aa, Homo sapiens
  Heavy chain CDR1
GFTFDDYG

SEQ ID NO: 10702 - protein, 8 aa, Homo sapiens
  Heavy chain CDR1
GFTFDDYG

SEQ ID NO: 10703 - protein, 8 aa, Homo sapiens
  Heavy chain CDR1
GFIFEDYG

SEQ ID NO: 10704 - protein, 8 aa, Homo sapiens
  Heavy chain CDR1
GFTFDDYG

SEQ ID NO: 10705 - protein, 8 aa, Homo sapiens
  Heavy chain CDR1
GYTFTSYG

SEQ ID NO: 10706 - protein, 8 aa, Homo sapiens
  Heavy chain CDR1
GFIFEDYG

SEQ ID NO: 10707 - protein, 8 aa, Homo sapiens
  Heavy chain CDR1
GFIFEDYG

SEQ ID NO: 10708 - protein, 8 aa, Homo sapiens
  Heavy chain CDR1
GFIFEDYG

SEQ ID NO: 10709 - protein, 8 aa, Homo sapiens
  Heavy chain CDR1
GFTFDDYG

SEQ ID NO: 10710 - protein, 8 aa, Homo sapiens
  Heavy chain CDR1
GFIFEDYG

SEQ ID NO: 10711 - protein, 8 aa, Homo sapiens
  Heavy chain CDR1
GFTLRGYG

SEQ ID NO: 10712 - protein, 8 aa, Homo sapiens
  Heavy chain CDR1
GFIFEDYG

SEQ ID NO: 10713 - protein, 8 aa, Homo sapiens
  Heavy chain CDR1
GYTFTSYG

SEQ ID NO: 10714 - protein, 8 aa, Homo sapiens
  Heavy chain CDR1
GFTFDDYG

SEQ ID NO: 10715 - protein, 8 aa, Homo sapiens
  Heavy chain CDR1
GFIFSSYG

SEQ ID NO: 10716 - protein, 8 aa, Homo sapiens
  Heavy chain CDR1
GYTFTNYG

SEQ ID NO: 10717 - protein, 8 aa, Homo sapiens
  Heavy chain CDR1
GFIFEDYG

SEQ ID NO: 10718 - protein, 8 aa, Homo sapiens
  Heavy chain CDR1
GYTFTSYG

SEQ ID NO: 10719 - protein, 8 aa, Homo sapiens
  Heavy chain CDR1
GFTFSSHG

SEQ ID NO: 10720 - protein, 8 aa, Homo sapiens
  Heavy chain CDR1
GYTFNSYG

SEQ ID NO: 10721 - protein, 8 aa, Homo sapiens
  Heavy chain CDR1
GFIFSSYG

SEQ ID NO: 10722 - protein, 8 aa, Homo sapiens
  Heavy chain CDR1
GFTFSSYG

SEQ ID NO: 10723 - protein, 8 aa, Homo sapiens
  Heavy chain CDR1
GFTFSSHG

SEQ ID NO: 10724 - protein, 8 aa, Homo sapiens
  Heavy chain CDR1
GFTFSSHG

SEQ ID NO: 10725 - protein, 8 aa, Homo sapiens
  Heavy chain CDR1
GFTFSSHA

SEQ ID NO: 10726 - protein, 8 aa, Homo sapiens
  Heavy chain CDR1
GFTFSSYG

SEQ ID NO: 10727 - protein, 8 aa, Homo sapiens
  Heavy chain CDR1
GGSISSYY

SEQ ID NO: 10728 - protein, 8 aa, Homo sapiens
  Heavy chain CDR1
GFTFSSHA

SEQ ID NO: 10729 - protein, 8 aa, Homo sapiens
  Heavy chain CDR1
GYTFTSYG

SEQ ID NO: 10730 - protein, 8 aa, Homo sapiens
  Heavy chain CDR1
GFTFSSHG

SEQ ID NO: 10731 - protein, 8 aa, Homo sapiens
  Heavy chain CDR1
GFTFSSYG

SEQ ID NO: 10732 - protein, 8 aa, Homo sapiens
  Heavy chain CDR1
GFTFSTHG

SEQ ID NO: 10733 - protein, 8 aa, Homo sapiens
  Heavy chain CDR1
GFTFSTHG

SEQ ID NO: 10734 - protein, 8 aa, Homo sapiens
  Heavy chain CDR1
GFTFSSYG

SEQ ID NO: 10735 - protein, 8 aa, Homo sapiens
  Heavy chain CDR1
GFTFSTHG

SEQ ID NO: 10736 - protein, 8 aa, Homo sapiens
  Heavy chain CDR1
GYTFTSYG

SEQ ID NO: 10737 - protein, 8 aa, Homo sapiens
  Heavy chain CDR1
GYTFTSYG

SEQ ID NO: 10738 - protein, 8 aa, Homo sapiens
  Heavy chain CDR1
GYTFTSYG

SEQ ID NO: 10739 - protein, 8 aa, Homo sapiens
  Heavy chain CDR1
GYTFTSYG

SEQ ID NO: 10740 - protein, 8 aa, Homo sapiens
  Heavy chain CDR1
GYTFTSYG

SEQ ID NO: 10741 - protein, 8 aa, Homo sapiens
  Heavy chain CDR1
GFTFSSYG

SEQ ID NO: 10742 - protein, 8 aa, Homo sapiens
  Heavy chain CDR1
GFTFSSYG

SEQ ID NO: 10743 - protein, 8 aa, Homo sapiens
  Heavy chain CDR1
GFTFSSHG

SEQ ID NO: 10744 - protein, 8 aa, Homo sapiens
  Heavy chain CDR1
GYTFTSYG

SEQ ID NO: 10745 - protein, 8 aa, Homo sapiens
  Heavy chain CDR1
GYTFTNYG

SEQ ID NO: 10746 - protein, 8 aa, Homo sapiens
  Heavy chain CDR1
GYTFTSYG

SEQ ID NO: 10747 - protein, 8 aa, Homo sapiens
  Heavy chain CDR1
GYTFTSYG

SEQ ID NO: 10748 - protein, 8 aa, Homo sapiens
  Heavy chain CDR1
GFTFSSYG

SEQ ID NO: 10749 - protein, 8 aa, Homo sapiens
  Heavy chain CDR1
GYTFTSYG

SEQ ID NO: 10750 - protein, 8 aa, Homo sapiens
  Heavy chain CDR1
GFTFSTHG

SEQ ID NO: 10751 - protein, 8 aa, Homo sapiens
  Heavy chain CDR1
GFTFSSHG

SEQ ID NO: 10752 - protein, 8 aa, Homo sapiens
  Heavy chain CDR1
GYTFTSYG

SEQ ID NO: 10753 - protein, 8 aa, Homo sapiens
  Heavy chain CDR1
GFTFSSHG

SEQ ID NO: 10754 - protein, 8 aa, Homo sapiens
  Heavy chain CDR1
GYTFNSYG

SEQ ID NO: 10755 - protein, 8 aa, Homo sapiens
  Heavy chain CDR1
GFTFSSYG

SEQ ID NO: 10756 - protein, 8 aa, Homo sapiens
  Heavy chain CDR1
GFTFSSYG

SEQ ID NO: 10757 - protein, 8 aa, Homo sapiens
  Heavy chain CDR1
GFTFSSHG

SEQ ID NO: 10758 - protein, 8 aa, Homo sapiens
  Heavy chain CDR1
GFTFSSHG

SEQ ID NO: 10759 - protein, 8 aa, Homo sapiens
  Heavy chain CDR1
GFTFSSYG

SEQ ID NO: 10760 - protein, 8 aa, Homo sapiens
  Heavy chain CDR1
GFTFSSYG

SEQ ID NO: 10761 - protein, 8 aa, Homo sapiens
  Heavy chain CDR1
GFTFSSYG

SEQ ID NO: 10762 - protein, 8 aa, Homo sapiens
  Heavy chain CDR1
GFTFRSYG

SEQ ID NO: 10763 - protein, 8 aa, Homo sapiens
  Heavy chain CDR1
GFTFSSYG

SEQ ID NO: 10764 - protein, 8 aa, Homo sapiens
  Heavy chain CDR1
GFTFSSYG

SEQ ID NO: 10765 - protein, 8 aa, Homo sapiens
  Heavy chain CDR1
GFAFSSYG

SEQ ID NO: 10766 - protein, 8 aa, Homo sapiens
  Heavy chain CDR1
GFTFSSYG

SEQ ID NO: 10767 - protein, 8 aa, Homo sapiens
  Heavy chain CDR1
GFTFSSYG

SEQ ID NO: 10768 - protein, 8 aa, Homo sapiens
  Heavy chain CDR1
GFTFSSYG

SEQ ID NO: 10769 - protein, 8 aa, Homo sapiens
  Heavy chain CDR1
GFTFSSYG

SEQ ID NO: 10770 - protein, 8 aa, Homo sapiens
  Heavy chain CDR1
GFTFSSYG

SEQ ID NO: 10771 - protein, 8 aa, Homo sapiens
  Heavy chain CDR1
GFTFSSYG

SEQ ID NO: 10772 - protein, 8 aa, Homo sapiens
  Heavy chain CDR1
GFTFSSYG

SEQ ID NO: 10773 - protein, 8 aa, Homo sapiens
  Heavy chain CDR1
GFTFSSYG

SEQ ID NO: 10774 - protein, 8 aa, Homo sapiens
  Heavy chain CDR1
GFTFSSYG

SEQ ID NO: 10775 - protein, 8 aa, Homo sapiens
  Heavy chain CDR1
GFTFSSYG

SEQ ID NO: 10776 - protein, 8 aa, Homo sapiens
  Heavy chain CDR1
GFTFSSYG

SEQ ID NO: 10777 - protein, 8 aa, Homo sapiens
  Heavy chain CDR1
GFTFSSYG

SEQ ID NO: 10778 - protein, 8 aa, Homo sapiens
  Heavy chain CDR1
GFTFSSYG

SEQ ID NO: 10779 - protein, 8 aa, Homo sapiens
  Heavy chain CDR1
GFTFSSYG

SEQ ID NO: 10780 - protein, 8 aa, Homo sapiens
  Heavy chain CDR1
GFTFSSYG

SEQ ID NO: 10781 - protein, 8 aa, Homo sapiens
  Heavy chain CDR1
GFTFSSFG

SEQ ID NO: 10782 - protein, 8 aa, Homo sapiens
  Heavy chain CDR1
GFTFSSYG

SEQ ID NO: 10783 - protein, 8 aa, Homo sapiens
  Heavy chain CDR1
GFTFSSYG

SEQ ID NO: 10784 - protein, 8 aa, Homo sapiens
  Heavy chain CDR1
GGSISSYY

SEQ ID NO: 10785 - protein, 8 aa, Homo sapiens
  Heavy chain CDR1
GFIFSSYG

SEQ ID NO: 10786 - protein, 8 aa, Homo sapiens
  Heavy chain CDR1
GFTFSIYT

SEQ ID NO: 10787 - protein, 8 aa, Homo sapiens
  Heavy chain CDR1
GFTFSSFG

SEQ ID NO: 10788 - protein, 8 aa, Homo sapiens
  Heavy chain CDR1
GFTFSSYG

SEQ ID NO: 10789 - protein, 8 aa, Homo sapiens
  Heavy chain CDR1
GFTFSSHG

SEQ ID NO: 10790 - protein, 8 aa, Homo sapiens
  Heavy chain CDR1
GFTFSSHG

SEQ ID NO: 10791 - protein, 8 aa, Homo sapiens
  Heavy chain CDR1
GFTFSSYG

SEQ ID NO: 10792 - protein, 8 aa, Homo sapiens
  Heavy chain CDR1
GGSISSYY

SEQ ID NO: 10793 - protein, 8 aa, Homo sapiens
  Heavy chain CDR1
GFTFSSHG

SEQ ID NO: 10794 - protein, 8 aa, Homo sapiens
  Heavy chain CDR1
GFTFSSYG

SEQ ID NO: 10795 - protein, 8 aa, Homo sapiens
  Heavy chain CDR1
GFTFSSYG

SEQ ID NO: 10796 - protein, 8 aa, Homo sapiens
  Heavy chain CDR1
GFTFSNYG

SEQ ID NO: 10797 - protein, 8 aa, Homo sapiens
  Heavy chain CDR1
GFTFSSYG

SEQ ID NO: 10798 - protein, 8 aa, Homo sapiens
  Heavy chain CDR1
GFTFSSYW

SEQ ID NO: 10799 - protein, 8 aa, Homo sapiens
  Heavy chain CDR1
GFTFSSYA

SEQ ID NO: 10800 - protein, 10 aa, Homo sapiens
  Heavy chain CDR1
GGSISSSSYY

SEQ ID NO: 10801 - protein, 8 aa, Homo sapiens
  Heavy chain CDR1
GFTFSSYG

SEQ ID NO: 10802 - protein, 8 aa, Homo sapiens
  Heavy chain CDR1
GFTLSSYG

SEQ ID NO: 10803 - protein, 8 aa, Homo sapiens
  Heavy chain CDR1
GFTFSSYG

SEQ ID NO: 10804 - protein, 8 aa, Homo sapiens
  Heavy chain CDR1
GYTFTSYG

SEQ ID NO: 10805 - protein, 8 aa, Homo sapiens
  Heavy chain CDR1
GFTFSSYG

SEQ ID NO: 10806 - protein, 8 aa, Homo sapiens
  Heavy chain CDR1
GFTFSSYG

SEQ ID NO: 10807 - protein, 8 aa, Homo sapiens
  Heavy chain CDR1
GFTFSSFG

SEQ ID NO: 10808 - protein, 8 aa, Homo sapiens
  Heavy chain CDR1
GYTFTNYG

SEQ ID NO: 10809 - protein, 8 aa, Homo sapiens
  Heavy chain CDR1
GFTFSSYG

SEQ ID NO: 10810 - protein, 8 aa, Homo sapiens
  Heavy chain CDR1
GFTFSSYG

SEQ ID NO: 10811 - protein, 10 aa, Homo sapiens
  Heavy chain CDR1
GDSVSSNRAA

SEQ ID NO: 10812 - protein, 8 aa, Homo sapiens
  Heavy chain CDR1
GFTFGDYA

SEQ ID NO: 10813 - protein, 8 aa, Homo sapiens
  Heavy chain CDR1
GFTFSSYG

SEQ ID NO: 10814 - protein, 8 aa, Homo sapiens
  Heavy chain CDR1
GYTFTSYG

SEQ ID NO: 10815 - protein, 8 aa, Homo sapiens
  Heavy chain CDR1
GFTFRSYG

SEQ ID NO: 10816 - protein, 8 aa, Homo sapiens
  Heavy chain CDR1
GFTFSSYG

SEQ ID NO: 10817 - protein, 8 aa, Homo sapiens
  Heavy chain CDR1
GVSISSYY

SEQ ID NO: 10818 - protein, 8 aa, Homo sapiens
  Heavy chain CDR1
GFTFSSYG

SEQ ID NO: 10819 - protein, 8 aa, Homo sapiens
  Heavy chain CDR1
GFTFSSHG

SEQ ID NO: 10820 - protein, 8 aa, Homo sapiens
  Heavy chain CDR1
GFTFSSYG

SEQ ID NO: 10821 - protein, 8 aa, Homo sapiens
  Heavy chain CDR1
GFTFSSYG

SEQ ID NO: 10822 - protein, 8 aa, Homo sapiens
  Heavy chain CDR1
GFTFSSYG

SEQ ID NO: 10823 - protein, 8 aa, Homo sapiens
  Heavy chain CDR1
GFTFSNYG

SEQ ID NO: 10824 - protein, 8 aa, Homo sapiens
  Heavy chain CDR1
GFTFSSFG

SEQ ID NO: 10825 - protein, 8 aa, Homo sapiens
  Heavy chain CDR1
GFTFSSYG

SEQ ID NO: 10826 - protein, 8 aa, Homo sapiens
  Heavy chain CDR1
GFTFSSHG

SEQ ID NO: 10827 - protein, 8 aa, Homo sapiens
  Heavy chain CDR1
GFTFSSYG

SEQ ID NO: 10828 - protein, 8 aa, Homo sapiens
  Heavy chain CDR1
GYTFTSYG

SEQ ID NO: 10829 - protein, 8 aa, Homo sapiens
  Heavy chain CDR1
GFTFSSHG

SEQ ID NO: 10830 - protein, 8 aa, Homo sapiens
  Heavy chain CDR1
GFTFSSHG

SEQ ID NO: 10831 - protein, 8 aa, Homo sapiens
  Heavy chain CDR1
GFTFSSHG

SEQ ID NO: 10832 - protein, 8 aa, Homo sapiens
  Heavy chain CDR1
GFTFSSYG

SEQ ID NO: 10833 - protein, 8 aa, Homo sapiens
  Heavy chain CDR1
GFTFSSYG

SEQ ID NO: 10834 - protein, 8 aa, Homo sapiens
  Heavy chain CDR1
GFTFSSHG

SEQ ID NO: 10835 - protein, 8 aa, Homo sapiens
  Heavy chain CDR1
GFTFSSYG

SEQ ID NO: 10836 - protein, 8 aa, Homo sapiens
  Heavy chain CDR1
GFTFSSYG

SEQ ID NO: 10837 - protein, 8 aa, Homo sapiens
  Heavy chain CDR1
GFTFSSYG

SEQ ID NO: 10838 - protein, 8 aa, Homo sapiens
  Heavy chain CDR1
GFTFSSYG

SEQ ID NO: 10839 - protein, 8 aa, Homo sapiens
  Heavy chain CDR1
GFTFSSHG

SEQ ID NO: 10840 - protein, 8 aa, Homo sapiens
  Heavy chain CDR1
GFTFSSYG

SEQ ID NO: 10841 - protein, 8 aa, Homo sapiens
  Heavy chain CDR1
GFTFSNYA

SEQ ID NO: 10842 - protein, 8 aa, Homo sapiens
  Heavy chain CDR1
GFTFSSYG

SEQ ID NO: 10843 - protein, 8 aa, Homo sapiens
  Heavy chain CDR1
GFTFSSYG

SEQ ID NO: 10844 - protein, 8 aa, Homo sapiens
  Heavy chain CDR1
GFTFSSYG

SEQ ID NO: 10845 - protein, 8 aa, Homo sapiens
  Heavy chain CDR1
GFTFSSHG

SEQ ID NO: 10846 - protein, 8 aa, Homo sapiens
  Heavy chain CDR1
GFTFSSYG

SEQ ID NO: 10847 - protein, 8 aa, Homo sapiens
  Heavy chain CDR1
GFTFSSHG

SEQ ID NO: 10848 - protein, 8 aa, Homo sapiens
  Heavy chain CDR1
GFTFSSYG

SEQ ID NO: 10849 - protein, 8 aa, Homo sapiens
  Heavy chain CDR1
GFTFSSHG

SEQ ID NO: 10850 - protein, 8 aa, Homo sapiens
  Heavy chain CDR1
GFTFSSHG

SEQ ID NO: 10851 - protein, 8 aa, Homo sapiens
  Heavy chain CDR1
GFTFSSHG

SEQ ID NO: 10852 - protein, 8 aa, Homo sapiens
  Heavy chain CDR1
GFTFSSHG

SEQ ID NO: 10853 - protein, 8 aa, Homo sapiens
  Heavy chain CDR1
GFTFSSHG

SEQ ID NO: 10854 - protein, 8 aa, Homo sapiens
  Heavy chain CDR1
GFTFSSYG

SEQ ID NO: 10855 - protein, 8 aa, Homo sapiens
  Heavy chain CDR1
GFTFSSYG

SEQ ID NO: 10856 - protein, 8 aa, Homo sapiens
  Heavy chain CDR1
GFTFSSYG

SEQ ID NO: 10857 - protein, 8 aa, Homo sapiens
  Heavy chain CDR1
GFTFSSYG

SEQ ID NO: 10858 - protein, 8 aa, Homo sapiens
  Heavy chain CDR1
GYTFTDYG

SEQ ID NO: 10859 - protein, 8 aa, Homo sapiens
  Heavy chain CDR1
GFTLSSFG

SEQ ID NO: 10860 - protein, 8 aa, Homo sapiens
  Heavy chain CDR1
GFTFSNYA

SEQ ID NO: 10861 - protein, 8 aa, Homo sapiens
  Heavy chain CDR1
GFTFSSYG

SEQ ID NO: 10862 - protein, 8 aa, Homo sapiens
  Heavy chain CDR1
GFTFRSYG

SEQ ID NO: 10863 - protein, 8 aa, Homo sapiens
  Heavy chain CDR1
GFTFSSYG

SEQ ID NO: 10864 - protein, 8 aa, Homo sapiens
  Heavy chain CDR1
GFTFSSYG

SEQ ID NO: 10865 - protein, 8 aa, Homo sapiens
  Heavy chain CDR1
GFTFSSYA

SEQ ID NO: 10866 - protein, 8 aa, Homo sapiens
  Heavy chain CDR1
GFTFSSYG

SEQ ID NO: 10867 - protein, 8 aa, Homo sapiens
  Heavy chain CDR1
GFTFSRFG

SEQ ID NO: 10868 - protein, 8 aa, Homo sapiens
  Heavy chain CDR1
GYTFNYYG

SEQ ID NO: 10869 - protein, 8 aa, Homo sapiens
  Heavy chain CDR1
GFTLSSFG

SEQ ID NO: 10870 - protein, 8 aa, Homo sapiens
  Heavy chain CDR1
GFTFSNYG

SEQ ID NO: 10871 - protein, 8 aa, Homo sapiens
  Heavy chain CDR1
GFTFNSYG

SEQ ID NO: 10872 - protein, 8 aa, Homo sapiens
  Heavy chain CDR1
GFTFSSYG

SEQ ID NO: 10873 - protein, 8 aa, Homo sapiens
  Heavy chain CDR1
DYTFTYYG

SEQ ID NO: 10874 - protein, 8 aa, Homo sapiens
  Heavy chain CDR1
GYTFTSYG

SEQ ID NO: 10875 - protein, 8 aa, Homo sapiens
  Heavy chain CDR1
GFTFSSYG

SEQ ID NO: 10876 - protein, 8 aa, Homo sapiens
  Heavy chain CDR1
GFTFSSYG

SEQ ID NO: 10877 - protein, 8 aa, Homo sapiens
  Heavy chain CDR1
GFTFSNYG

SEQ ID NO: 10878 - protein, 8 aa, Homo sapiens
  Heavy chain CDR1
GYTFTSYG

SEQ ID NO: 10879 - protein, 8 aa, Homo sapiens
  Heavy chain CDR1
GFTFSSYG

SEQ ID NO: 10880 - protein, 8 aa, Homo sapiens
  Heavy chain CDR1
GFTFSSYG

SEQ ID NO: 10881 - protein, 8 aa, Homo sapiens
  Heavy chain CDR1
GFTFSSHG

SEQ ID NO: 10882 - protein, 8 aa, Homo sapiens
  Heavy chain CDR1
GFTFSSYG

SEQ ID NO: 10883 - protein, 8 aa, Homo sapiens
  Heavy chain CDR1
GFTFSSYG

SEQ ID NO: 10884 - protein, 8 aa, Homo sapiens
  Heavy chain CDR1
GYTFTSYG

SEQ ID NO: 10885 - protein, 8 aa, Homo sapiens
  Heavy chain CDR1
GYTFTSYG

SEQ ID NO: 10886 - protein, 8 aa, Homo sapiens
  Heavy chain CDR1
GFTLSSYG

SEQ ID NO: 10887 - protein, 8 aa, Homo sapiens
  Heavy chain CDR1
GFTFSSYG

SEQ ID NO: 10888 - protein, 8 aa, Homo sapiens
  Heavy chain CDR1
GFTFSSYG

SEQ ID NO: 10889 - protein, 8 aa, Homo sapiens
  Heavy chain CDR1
GFIFSSYG

SEQ ID NO: 10890 - protein, 8 aa, Homo sapiens
  Heavy chain CDR1
GFTLSSFG

SEQ ID NO: 10891 - protein, 8 aa, Homo sapiens
  Heavy chain CDR1
GYTFTSYG

SEQ ID NO: 10892 - protein, 8 aa, Homo sapiens
  Heavy chain CDR1
GFTFSSYG

SEQ ID NO: 10893 - protein, 8 aa, Homo sapiens
  Heavy chain CDR1
GFTFSSYG

SEQ ID NO: 10894 - protein, 8 aa, Homo sapiens
  Heavy chain CDR1
GFTFSRYG

SEQ ID NO: 10895 - protein, 8 aa, Homo sapiens
  Heavy chain CDR1
GFTFSSYG

SEQ ID NO: 10896 - protein, 8 aa, Homo sapiens
  Heavy chain CDR1
GFTFSSYG

SEQ ID NO: 10897 - protein, 8 aa, Homo sapiens
  Heavy chain CDR1
GFTFSSYG

SEQ ID NO: 10898 - protein, 8 aa, Homo sapiens
  Heavy chain CDR1
GYTFTNYG

SEQ ID NO: 10899 - protein, 8 aa, Homo sapiens
  Heavy chain CDR1
GFTFSSHG

SEQ ID NO: 10900 - protein, 8 aa, Homo sapiens
  Heavy chain CDR1
GFTFSSYG

SEQ ID NO: 10901 - protein, 8 aa, Homo sapiens
  Heavy chain CDR1
GYTFTNYG

SEQ ID NO: 10902 - protein, 8 aa, Homo sapiens
  Heavy chain CDR1
GFTFSSYG

SEQ ID NO: 10903 - protein, 8 aa, Homo sapiens
  Heavy chain CDR1
GFTFSSYG

SEQ ID NO: 10904 - protein, 8 aa, Homo sapiens
  Heavy chain CDR1
GYTFTNYG

SEQ ID NO: 10905 - protein, 8 aa, Homo sapiens
  Heavy chain CDR1
GYTFTSYG

SEQ ID NO: 10906 - protein, 8 aa, Homo sapiens
  Heavy chain CDR1
GFTFSSYG

SEQ ID NO: 10907 - protein, 8 aa, Homo sapiens
  Heavy chain CDR1
GFTFSSYG

SEQ ID NO: 10908 - protein, 8 aa, Homo sapiens
  Heavy chain CDR1
GFTFSSYG

SEQ ID NO: 10909 - protein, 8 aa, Homo sapiens
  Heavy chain CDR1
GYTFTNYG

SEQ ID NO: 10910 - protein, 8 aa, Homo sapiens
  Heavy chain CDR1
GYTFTSYG

SEQ ID NO: 10911 - protein, 8 aa, Homo sapiens
  Heavy chain CDR1
GYTFTSYG

SEQ ID NO: 10912 - protein, 8 aa, Homo sapiens
  Heavy chain CDR1
GFTFSSNG

SEQ ID NO: 10913 - protein, 8 aa, Homo sapiens
  Heavy chain CDR1
GFTFSSYG

SEQ ID NO: 10914 - protein, 8 aa, Homo sapiens
  Heavy chain CDR1
GFTFSSYG

SEQ ID NO: 10915 - protein, 8 aa, Homo sapiens
  Heavy chain CDR1
GYTFTSYG

SEQ ID NO: 10916 - protein, 8 aa, Homo sapiens
  Heavy chain CDR1
GFTFSRYG

SEQ ID NO: 10917 - protein, 8 aa, Homo sapiens
  Heavy chain CDR1
GYTFTNYG

SEQ ID NO: 10918 - protein, 8 aa, Homo sapiens
  Heavy chain CDR1
GFNFSSYG

SEQ ID NO: 10919 - protein, 8 aa, Homo sapiens
  Heavy chain CDR1
GFTFSSYG

SEQ ID NO: 10920 - protein, 8 aa, Homo sapiens
  Heavy chain CDR1
GYTFTSYG

SEQ ID NO: 10921 - protein, 8 aa, Homo sapiens
  Heavy chain CDR1
GFTFSSYG

SEQ ID NO: 10922 - protein, 8 aa, Homo sapiens
  Heavy chain CDR1
GFTFSSYG

SEQ ID NO: 10923 - protein, 8 aa, Homo sapiens
  Heavy chain CDR1
GFTFSSYG

SEQ ID NO: 10924 - protein, 8 aa, Homo sapiens
  Heavy chain CDR1
GFTFSSYG

SEQ ID NO: 10925 - protein, 8 aa, Homo sapiens
  Heavy chain CDR1
GFTFRSYG

SEQ ID NO: 10926 - protein, 8 aa, Homo sapiens
  Heavy chain CDR1
GFTFSSHG

SEQ ID NO: 10927 - protein, 8 aa, Homo sapiens
  Heavy chain CDR1
GFTFSSYG

SEQ ID NO: 10928 - protein, 8 aa, Homo sapiens
  Heavy chain CDR1
GFTFSSYG

SEQ ID NO: 10929 - protein, 8 aa, Homo sapiens
  Heavy chain CDR1
GFTFSRYG

SEQ ID NO: 10930 - protein, 8 aa, Homo sapiens
  Heavy chain CDR1
GFTFSSYG

SEQ ID NO: 10931 - protein, 8 aa, Homo sapiens
  Heavy chain CDR1
GFTFSNYG

SEQ ID NO: 10932 - protein, 8 aa, Homo sapiens
  Heavy chain CDR1
GFTFSSYG

SEQ ID NO: 10933 - protein, 8 aa, Homo sapiens
  Heavy chain CDR1
GFTLSNYG

SEQ ID NO: 10934 - protein, 8 aa, Homo sapiens
  Heavy chain CDR1
GFTFSSYG

SEQ ID NO: 10935 - protein, 8 aa, Homo sapiens
  Heavy chain CDR1
GYTFTSYG

SEQ ID NO: 10936 - protein, 8 aa, Homo sapiens
  Heavy chain CDR1
GFTFSNYG

SEQ ID NO: 10937 - protein, 8 aa, Homo sapiens
  Heavy chain CDR1
GFTFSSYG

SEQ ID NO: 10938 - protein, 8 aa, Homo sapiens
  Heavy chain CDR1
GFTFSSFG

SEQ ID NO: 10939 - protein, 8 aa, Homo sapiens
  Heavy chain CDR1
GFTFSSYG

SEQ ID NO: 10940 - protein, 8 aa, Homo sapiens
  Heavy chain CDR1
GYTFTSYY

SEQ ID NO: 10941 - protein, 8 aa, Homo sapiens
  Heavy chain CDR1
GYTFTSYY

SEQ ID NO: 10942 - protein, 10 aa, Homo sapiens
  Heavy chain CDR1
GGSISSSSYY

SEQ ID NO: 10943 - protein, 8 aa, Homo sapiens
  Heavy chain CDR1
GFTLSNYG

SEQ ID NO: 10944 - protein, 8 aa, Homo sapiens
  Heavy chain CDR1
GFTFSSYG

SEQ ID NO: 10945 - protein, 8 aa, Homo sapiens
  Heavy chain CDR1
GFTFSSYG

SEQ ID NO: 10946 - protein, 8 aa, Homo sapiens
  Heavy chain CDR1
GFTFSSYG

SEQ ID NO: 10947 - protein, 8 aa, Homo sapiens
  Heavy chain CDR1
GFTFSSYG

SEQ ID NO: 10948 - protein, 8 aa, Homo sapiens
  Heavy chain CDR1
GFTFSSYG

SEQ ID NO: 10949 - protein, 8 aa, Homo sapiens
  Heavy chain CDR1
GFTFSNYG

SEQ ID NO: 10950 - protein, 8 aa, Homo sapiens
  Heavy chain CDR1
GYTFTSYG

SEQ ID NO: 10951 - protein, 8 aa, Homo sapiens
  Heavy chain CDR1
GFTFSSYG

SEQ ID NO: 10952 - protein, 8 aa, Homo sapiens
  Heavy chain CDR1
GFTFSSYG

SEQ ID NO: 10953 - protein, 8 aa, Homo sapiens
  Heavy chain CDR1
GFTFSSYG

SEQ ID NO: 10954 - protein, 8 aa, Homo sapiens
  Heavy chain CDR1
GFTFSSYG

SEQ ID NO: 10955 - protein, 8 aa, Homo sapiens
  Heavy chain CDR1
GFTFSRYG

SEQ ID NO: 10956 - protein, 8 aa, Homo sapiens
  Heavy chain CDR1
GFTFSSYG

SEQ ID NO: 10957 - protein, 10 aa, Homo sapiens
  Heavy chain CDR1
GGSISSSSYY

SEQ ID NO: 10958 - protein, 8 aa, Homo sapiens
  Heavy chain CDR1
GFTFSSYG

SEQ ID NO: 10959 - protein, 8 aa, Homo sapiens
  Heavy chain CDR1
GYTFTSYG

SEQ ID NO: 10960 - protein, 8 aa, Homo sapiens
  Heavy chain CDR1
GFTFSSYG

SEQ ID NO: 10961 - protein, 8 aa, Homo sapiens
  Heavy chain CDR1
GYTFTSYG

SEQ ID NO: 10962 - protein, 8 aa, Homo sapiens
  Heavy chain CDR1
GFTFSSYG

SEQ ID NO: 10963 - protein, 8 aa, Homo sapiens
  Heavy chain CDR1
GFTLSNYG

SEQ ID NO: 10964 - protein, 8 aa, Homo sapiens
  Heavy chain CDR1
GFTFSSHG

SEQ ID NO: 10965 - protein, 8 aa, Homo sapiens
  Heavy chain CDR1
GFTFSSYG

SEQ ID NO: 10966 - protein, 8 aa, Homo sapiens
  Heavy chain CDR1
GFTLSNYG

SEQ ID NO: 10967 - protein, 10 aa, Homo sapiens
  Heavy chain CDR1
GGSISSSSYY

SEQ ID NO: 10968 - protein, 8 aa, Homo sapiens
  Heavy chain CDR1
GYTFTSYG

SEQ ID NO: 10969 - protein, 8 aa, Homo sapiens
  Heavy chain CDR1
GFTLSNYG

SEQ ID NO: 10970 - protein, 8 aa, Homo sapiens
  Heavy chain CDR1
GFTFSNYG

SEQ ID NO: 10971 - protein, 8 aa, Homo sapiens
  Heavy chain CDR1
GFTFSSYG

SEQ ID NO: 10972 - protein, 8 aa, Homo sapiens
  Heavy chain CDR1
GFTFSRYG

SEQ ID NO: 10973 - protein, 8 aa, Homo sapiens
  Heavy chain CDR1
GFTFSNYG

SEQ ID NO: 10974 - protein, 8 aa, Homo sapiens
  Heavy chain CDR1
GFTFSRYG

SEQ ID NO: 10975 - protein, 8 aa, Homo sapiens
  Heavy chain CDR1
GFTFSRYG

SEQ ID NO: 10976 - protein, 7 aa, Homo sapiens
  Heavy chain CDR2
IYYTGST

SEQ ID NO: 10977 - protein, 7 aa, Homo sapiens
  Heavy chain CDR2
IYYSGNT

SEQ ID NO: 10978 - protein, 7 aa, Homo sapiens
  Heavy chain CDR2
IYYSGNT

SEQ ID NO: 10979 - protein, 7 aa, Homo sapiens
  Heavy chain CDR2
IYYSGNT

SEQ ID NO: 10980 - protein, 8 aa, Homo sapiens
  Heavy chain CDR2
ISYDGSNK

SEQ ID NO: 10981 - protein, 7 aa, Homo sapiens
  Heavy chain CDR2
IYYSGNT

SEQ ID NO: 10982 - protein, 7 aa, Homo sapiens
  Heavy chain CDR2
IYYSGNT

SEQ ID NO: 10983 - protein, 7 aa, Homo sapiens
  Heavy chain CDR2
IYYSGST

SEQ ID NO: 10984 - protein, 10 aa, Homo sapiens
  Heavy chain CDR2
IKSKTDGGTT

SEQ ID NO: 10985 - protein, 8 aa, Homo sapiens
  Heavy chain CDR2
ISAYNGNT

SEQ ID NO: 10986 - protein, 7 aa, Homo sapiens
  Heavy chain CDR2
IYYSGNT

SEQ ID NO: 10987 - protein, 8 aa, Homo sapiens
  Heavy chain CDR2
INWNGGST

SEQ ID NO: 10988 - protein, 7 aa, Homo sapiens
  Heavy chain CDR2
IYYSGNT

SEQ ID NO: 10989 - protein, 8 aa, Homo sapiens
  Heavy chain CDR2
INWNGGST

SEQ ID NO: 10990 - protein, 7 aa, Homo sapiens
  Heavy chain CDR2
IYYSGNT

SEQ ID NO: 10991 - protein, 7 aa, Homo sapiens
  Heavy chain CDR2
IYYSGNT

SEQ ID NO: 10992 - protein, 8 aa, Homo sapiens
  Heavy chain CDR2
IWYDGSNK

SEQ ID NO: 10993 - protein, 10 aa, Homo sapiens
  Heavy chain CDR2
IKSKTDGGTT

SEQ ID NO: 10994 - protein, 7 aa, Homo sapiens
  Heavy chain CDR2
IYYSGNT

SEQ ID NO: 10995 - protein, 7 aa, Homo sapiens
  Heavy chain CDR2
IYYTGST

SEQ ID NO: 10996 - protein, 7 aa, Homo sapiens
  Heavy chain CDR2
IYYTGST

SEQ ID NO: 10997 - protein, 8 aa, Homo sapiens
  Heavy chain CDR2
ISAYNGNT

SEQ ID NO: 10998 - protein, 10 aa, Homo sapiens
  Heavy chain CDR2
IKSKTDGGTT

SEQ ID NO: 10999 - protein, 7 aa, Homo sapiens
  Heavy chain CDR2
IYYTGST

SEQ ID NO: 11000 - protein, 8 aa, Homo sapiens
  Heavy chain CDR2
ISAYNGNT

SEQ ID NO: 11001 - protein, 7 aa, Homo sapiens
  Heavy chain CDR2
IYYTGST

SEQ ID NO: 11002 - protein, 8 aa, Homo sapiens
  Heavy chain CDR2
INWNGGST

SEQ ID NO: 11003 - protein, 8 aa, Homo sapiens
  Heavy chain CDR2
IWYDGSNK

SEQ ID NO: 11004 - protein, 8 aa, Homo sapiens
  Heavy chain CDR2
INWNGGST

SEQ ID NO: 11005 - protein, 7 aa, Homo sapiens
  Heavy chain CDR2
IYYTGST

SEQ ID NO: 11006 - protein, 7 aa, Homo sapiens
  Heavy chain CDR2
MYYSGST

SEQ ID NO: 11007 - protein, 8 aa, Homo sapiens
  Heavy chain CDR2
ISAYNGNT

SEQ ID NO: 11008 - protein, 7 aa, Homo sapiens
  Heavy chain CDR2
IYYTGST

SEQ ID NO: 11009 - protein, 7 aa, Homo sapiens
  Heavy chain CDR2
IYYTGST

SEQ ID NO: 11010 - protein, 8 aa, Homo sapiens
  Heavy chain CDR2
IWHDGSNK

SEQ ID NO: 11011 - protein, 8 aa, Homo sapiens
  Heavy chain CDR2
ISAYNGNT

SEQ ID NO: 11012 - protein, 7 aa, Homo sapiens
  Heavy chain CDR2
IYYSGNT

SEQ ID NO: 11013 - protein, 7 aa, Homo sapiens
  Heavy chain CDR2
IYYTGST

SEQ ID NO: 11014 - protein, 10 aa, Homo sapiens
  Heavy chain CDR2
IKSKTDGGTT

SEQ ID NO: 11015 - protein, 8 aa, Homo sapiens
  Heavy chain CDR2
INWNGGST

SEQ ID NO: 11016 - protein, 7 aa, Homo sapiens
  Heavy chain CDR2
IYYSGNT

SEQ ID NO: 11017 - protein, 7 aa, Homo sapiens
  Heavy chain CDR2
IYYSGNT

SEQ ID NO: 11018 - protein, 7 aa, Homo sapiens
  Heavy chain CDR2
IYYTGST

SEQ ID NO: 11019 - protein, 7 aa, Homo sapiens
  Heavy chain CDR2
IYYSGNT

SEQ ID NO: 11020 - protein, 8 aa, Homo sapiens
  Heavy chain CDR2
INWNGGST

SEQ ID NO: 11021 - protein, 8 aa, Homo sapiens
  Heavy chain CDR2
INWNGGST

SEQ ID NO: 11022 - protein, 8 aa, Homo sapiens
  Heavy chain CDR2
IWYDGNNK

SEQ ID NO: 11023 - protein, 8 aa, Homo sapiens
  Heavy chain CDR2
IWYDGNNK

SEQ ID NO: 11024 - protein, 8 aa, Homo sapiens
  Heavy chain CDR2
IWYDGRNK

SEQ ID NO: 11025 - protein, 8 aa, Homo sapiens
  Heavy chain CDR2
IWYDGSNK

SEQ ID NO: 11026 - protein, 7 aa, Homo sapiens
  Heavy chain CDR2
IYYSGHT

SEQ ID NO: 11027 - protein, 8 aa, Homo sapiens
  Heavy chain CDR2
IFNDGNNK

SEQ ID NO: 11028 - protein, 8 aa, Homo sapiens
  Heavy chain CDR2
TWYDGSNK

SEQ ID NO: 11029 - protein, 8 aa, Homo sapiens
  Heavy chain CDR2
IWYDGSNK

SEQ ID NO: 11030 - protein, 8 aa, Homo sapiens
  Heavy chain CDR2
IWYDGNNK

SEQ ID NO: 11031 - protein, 8 aa, Homo sapiens
  Heavy chain CDR2
TWYDGSNK

SEQ ID NO: 11032 - protein, 8 aa, Homo sapiens
  Heavy chain CDR2
IWYDGNNK

SEQ ID NO: 11033 - protein, 8 aa, Homo sapiens
  Heavy chain CDR2
IWYDGSNK

SEQ ID NO: 11034 - protein, 8 aa, Homo sapiens
  Heavy chain CDR2
IWYDGNNK

SEQ ID NO: 11035 - protein, 8 aa, Homo sapiens
  Heavy chain CDR2
IFNDGNNK

SEQ ID NO: 11036 - protein, 8 aa, Homo sapiens
  Heavy chain CDR2
IWYDGNNK

SEQ ID NO: 11037 - protein, 8 aa, Homo sapiens
  Heavy chain CDR2
IWYGGSNK

SEQ ID NO: 11038 - protein, 8 aa, Homo sapiens
  Heavy chain CDR2
IWYDGNNR

SEQ ID NO: 11039 - protein, 8 aa, Homo sapiens
  Heavy chain CDR2
IWYDGSNK

SEQ ID NO: 11040 - protein, 8 aa, Homo sapiens
  Heavy chain CDR2
TWYDGSNK

SEQ ID NO: 11041 - protein, 8 aa, Homo sapiens
  Heavy chain CDR2
IWYDGSNK

SEQ ID NO: 11042 - protein, 8 aa, Homo sapiens
  Heavy chain CDR2
IWYDGRNK

SEQ ID NO: 11043 - protein, 8 aa, Homo sapiens
  Heavy chain CDR2
IWYDGSNK

SEQ ID NO: 11044 - protein, 8 aa, Homo sapiens
  Heavy chain CDR2
IWYDGNNK

SEQ ID NO: 11045 - protein, 8 aa, Homo sapiens
  Heavy chain CDR2
IWYDGNNK

SEQ ID NO: 11046 - protein, 8 aa, Homo sapiens
  Heavy chain CDR2
IWYDGSNK

SEQ ID NO: 11047 - protein, 8 aa, Homo sapiens
  Heavy chain CDR2
IWYDGNNK

SEQ ID NO: 11048 - protein, 8 aa, Homo sapiens
  Heavy chain CDR2
IWYDGNNK

SEQ ID NO: 11049 - protein, 8 aa, Homo sapiens
  Heavy chain CDR2
IWYDGSNK

SEQ ID NO: 11050 - protein, 8 aa, Homo sapiens
  Heavy chain CDR2
IWYDGSNK

SEQ ID NO: 11051 - protein, 8 aa, Homo sapiens
  Heavy chain CDR2
IWYDGNNK

SEQ ID NO: 11052 - protein, 8 aa, Homo sapiens
  Heavy chain CDR2
IWYDGNNK

SEQ ID NO: 11053 - protein, 8 aa, Homo sapiens
  Heavy chain CDR2
VWYDGSNK

SEQ ID NO: 11054 - protein, 8 aa, Homo sapiens
  Heavy chain CDR2
IWYDGNNK

SEQ ID NO: 11055 - protein, 8 aa, Homo sapiens
  Heavy chain CDR2
IWYDGRNK

SEQ ID NO: 11056 - protein, 8 aa, Homo sapiens
  Heavy chain CDR2
IWYDGSNK

SEQ ID NO: 11057 - protein, 8 aa, Homo sapiens
  Heavy chain CDR2
IWDDGRNK

SEQ ID NO: 11058 - protein, 8 aa, Homo sapiens
  Heavy chain CDR2
IWYDGSNK

SEQ ID NO: 11059 - protein, 8 aa, Homo sapiens
  Heavy chain CDR2
IWYDGSNK

SEQ ID NO: 11060 - protein, 8 aa, Homo sapiens
  Heavy chain CDR2
IWDDGRNK

SEQ ID NO: 11061 - protein, 8 aa, Homo sapiens
  Heavy chain CDR2
LWYDGSNK

SEQ ID NO: 11062 - protein, 8 aa, Homo sapiens
  Heavy chain CDR2
IWDDGRNK

SEQ ID NO: 11063 - protein, 7 aa, Homo sapiens
  Heavy chain CDR2
IYYSGST

SEQ ID NO: 11064 - protein, 7 aa, Homo sapiens
  Heavy chain CDR2
IYYSGST

SEQ ID NO: 11065 - protein, 8 aa, Homo sapiens
  Heavy chain CDR2
IWYDGSNK

SEQ ID NO: 11066 - protein, 8 aa, Homo sapiens
  Heavy chain CDR2
IWYDGRNK

SEQ ID NO: 11067 - protein, 8 aa, Homo sapiens
  Heavy chain CDR2
IWYDGSNK

SEQ ID NO: 11068 - protein, 7 aa, Homo sapiens
  Heavy chain CDR2
IYYSGST

SEQ ID NO: 11069 - protein, 8 aa, Homo sapiens
  Heavy chain CDR2
IWDDGINK

SEQ ID NO: 11070 - protein, 8 aa, Homo sapiens
  Heavy chain CDR2
IWYDGSNK

SEQ ID NO: 11071 - protein, 7 aa, Homo sapiens
  Heavy chain CDR2
IYYSGST

SEQ ID NO: 11072 - protein, 8 aa, Homo sapiens
  Heavy chain CDR2
IWYDGSNK

SEQ ID NO: 11073 - protein, 8 aa, Homo sapiens
  Heavy chain CDR2
IWYDGSNK

SEQ ID NO: 11074 - protein, 7 aa, Homo sapiens
  Heavy chain CDR2
IYYSGST

SEQ ID NO: 11075 - protein, 8 aa, Homo sapiens
  Heavy chain CDR2
IWYDGSNK

SEQ ID NO: 11076 - protein, 8 aa, Homo sapiens
  Heavy chain CDR2
IWYDGSNK

SEQ ID NO: 11077 - protein, 8 aa, Homo sapiens
  Heavy chain CDR2
IWYDGSNK

SEQ ID NO: 11078 - protein, 8 aa, Homo sapiens
  Heavy chain CDR2
IGYDGSDK

SEQ ID NO: 11079 - protein, 7 aa, Homo sapiens
  Heavy chain CDR2
IYYSGST

SEQ ID NO: 11080 - protein, 7 aa, Homo sapiens
  Heavy chain CDR2
IYYSGST

SEQ ID NO: 11081 - protein, 8 aa, Homo sapiens
  Heavy chain CDR2
IWYDGSNK

SEQ ID NO: 11082 - protein, 10 aa, Homo sapiens
  Heavy chain CDR2
IRRKAYGGTT

SEQ ID NO: 11083 - protein, 7 aa, Homo sapiens
  Heavy chain CDR2
IYYSGST

SEQ ID NO: 11084 - protein, 7 aa, Homo sapiens
  Heavy chain CDR2
IYYSGST

SEQ ID NO: 11085 - protein, 7 aa, Homo sapiens
  Heavy chain CDR2
IYYSGST

SEQ ID NO: 11086 - protein, 8 aa, Homo sapiens
  Heavy chain CDR2
IWYDGSNK

SEQ ID NO: 11087 - protein, 7 aa, Homo sapiens
  Heavy chain CDR2
IYYSGST

SEQ ID NO: 11088 - protein, 7 aa, Homo sapiens
  Heavy chain CDR2
IYYSGST

SEQ ID NO: 11089 - protein, 8 aa, Homo sapiens
  Heavy chain CDR2
IWDDGRNK

SEQ ID NO: 11090 - protein, 8 aa, Homo sapiens
  Heavy chain CDR2
IWYDGSNK

SEQ ID NO: 11091 - protein, 8 aa, Homo sapiens
  Heavy chain CDR2
IWYDGSNK

SEQ ID NO: 11092 - protein, 8 aa, Homo sapiens
  Heavy chain CDR2
IWYDGSNK

SEQ ID NO: 11093 - protein, 8 aa, Homo sapiens
  Heavy chain CDR2
IWYDGSNK

SEQ ID NO: 11094 - protein, 7 aa, Homo sapiens
  Heavy chain CDR2
IYYSGST

SEQ ID NO: 11095 - protein, 8 aa, Homo sapiens
  Heavy chain CDR2
IWDDGKNK

SEQ ID NO: 11096 - protein, 8 aa, Homo sapiens
  Heavy chain CDR2
IWYDGSNK

SEQ ID NO: 11097 - protein, 8 aa, Homo sapiens
  Heavy chain CDR2
IWDDGKNK

SEQ ID NO: 11098 - protein, 7 aa, Homo sapiens
  Heavy chain CDR2
IYYSGST

SEQ ID NO: 11099 - protein, 8 aa, Homo sapiens
  Heavy chain CDR2
IWYDGSNK

SEQ ID NO: 11100 - protein, 8 aa, Homo sapiens
  Heavy chain CDR2
IWYDGSNK

SEQ ID NO: 11101 - protein, 7 aa, Homo sapiens
  Heavy chain CDR2
IYYSGST

SEQ ID NO: 11102 - protein, 7 aa, Homo sapiens
  Heavy chain CDR2
IYYSGST

SEQ ID NO: 11103 - protein, 8 aa, Homo sapiens
  Heavy chain CDR2
IWDDGRNK

SEQ ID NO: 11104 - protein, 7 aa, Homo sapiens
  Heavy chain CDR2
IYYSGST

SEQ ID NO: 11105 - protein, 8 aa, Homo sapiens
  Heavy chain CDR2
IWDDGRNK

SEQ ID NO: 11106 - protein, 8 aa, Homo sapiens
  Heavy chain CDR2
IWYDGSNK

SEQ ID NO: 11107 - protein, 8 aa, Homo sapiens
  Heavy chain CDR2
IWYDGRNK

SEQ ID NO: 11108 - protein, 8 aa, Homo sapiens
  Heavy chain CDR2
INWNGGST

SEQ ID NO: 11109 - protein, 8 aa, Homo sapiens
  Heavy chain CDR2
INWNGGST

SEQ ID NO: 11110 - protein, 8 aa, Homo sapiens
  Heavy chain CDR2
ISAYNGNT

SEQ ID NO: 11111 - protein, 8 aa, Homo sapiens
  Heavy chain CDR2
INWNGGNT

SEQ ID NO: 11112 - protein, 8 aa, Homo sapiens
  Heavy chain CDR2
ISAYNGNT

SEQ ID NO: 11113 - protein, 8 aa, Homo sapiens
  Heavy chain CDR2
ISVYNGNT

SEQ ID NO: 11114 - protein, 8 aa, Homo sapiens
  Heavy chain CDR2
IWYDGRNK

SEQ ID NO: 11115 - protein, 8 aa, Homo sapiens
  Heavy chain CDR2
IWYDGRNK

SEQ ID NO: 11116 - protein, 8 aa, Homo sapiens
  Heavy chain CDR2
INPSGGSS

SEQ ID NO: 11117 - protein, 8 aa, Homo sapiens
  Heavy chain CDR2
IWNDGSNK

SEQ ID NO: 11118 - protein, 8 aa, Homo sapiens
  Heavy chain CDR2
IWYDGRNK

SEQ ID NO: 11119 - protein, 8 aa, Homo sapiens
  Heavy chain CDR2
INPSGGSS

SEQ ID NO: 11120 - protein, 8 aa, Homo sapiens
  Heavy chain CDR2
ILYDGSNK

SEQ ID NO: 11121 - protein, 8 aa, Homo sapiens
  Heavy chain CDR2
IWYDGSNK

SEQ ID NO: 11122 - protein, 8 aa, Homo sapiens
  Heavy chain CDR2
IWYDGSNK

SEQ ID NO: 11123 - protein, 8 aa, Homo sapiens
  Heavy chain CDR2
IFYDGSNK

SEQ ID NO: 11124 - protein, 8 aa, Homo sapiens
  Heavy chain CDR2
ISAYNGNT

SEQ ID NO: 11125 - protein, 8 aa, Homo sapiens
  Heavy chain CDR2
IWYDGRNK

SEQ ID NO: 11126 - protein, 8 aa, Homo sapiens
  Heavy chain CDR2
ISAYNGNT

SEQ ID NO: 11127 - protein, 8 aa, Homo sapiens
  Heavy chain CDR2
ISAYNGNT

SEQ ID NO: 11128 - protein, 8 aa, Homo sapiens
  Heavy chain CDR2
IWYDGRNK

SEQ ID NO: 11129 - protein, 8 aa, Homo sapiens
  Heavy chain CDR2
INWNGGST

SEQ ID NO: 11130 - protein, 8 aa, Homo sapiens
  Heavy chain CDR2
INWNGGST

SEQ ID NO: 11131 - protein, 10 aa, Homo sapiens
  Heavy chain CDR2
IKSKTDGGTI

SEQ ID NO: 11132 - protein, 8 aa, Homo sapiens
  Heavy chain CDR2
IWNDGSNR

SEQ ID NO: 11133 - protein, 8 aa, Homo sapiens
  Heavy chain CDR2
IWYDGSNK

SEQ ID NO: 11134 - protein, 8 aa, Homo sapiens
  Heavy chain CDR2
IWNDGSNK

SEQ ID NO: 11135 - protein, 8 aa, Homo sapiens
  Heavy chain CDR2
INWNGGST

SEQ ID NO: 11136 - protein, 8 aa, Homo sapiens
  Heavy chain CDR2
IWNDGSNK

SEQ ID NO: 11137 - protein, 8 aa, Homo sapiens
  Heavy chain CDR2
IWYDGSNR

SEQ ID NO: 11138 - protein, 8 aa, Homo sapiens
  Heavy chain CDR2
IWNDGSNK

SEQ ID NO: 11139 - protein, 8 aa, Homo sapiens
  Heavy chain CDR2
IWYDGRNK

SEQ ID NO: 11140 - protein, 8 aa, Homo sapiens
  Heavy chain CDR2
IWYDGTIK

SEQ ID NO: 11141 - protein, 8 aa, Homo sapiens
  Heavy chain CDR2
IWYDGRNK

SEQ ID NO: 11142 - protein, 8 aa, Homo sapiens
  Heavy chain CDR2
IWYDGRNK

SEQ ID NO: 11143 - protein, 8 aa, Homo sapiens
  Heavy chain CDR2
IWYDGRNK

SEQ ID NO: 11144 - protein, 8 aa, Homo sapiens
  Heavy chain CDR2
INWNGGST

SEQ ID NO: 11145 - protein, 8 aa, Homo sapiens
  Heavy chain CDR2
ISVYNGNT

SEQ ID NO: 11146 - protein, 8 aa, Homo sapiens
  Heavy chain CDR2
INWNGGST

SEQ ID NO: 11147 - protein, 8 aa, Homo sapiens
  Heavy chain CDR2
IWYDGRNK

SEQ ID NO: 11148 - protein, 8 aa, Homo sapiens
  Heavy chain CDR2
IWYDGRNK

SEQ ID NO: 11149 - protein, 8 aa, Homo sapiens
  Heavy chain CDR2
ISAYNGNT

SEQ ID NO: 11150 - protein, 8 aa, Homo sapiens
  Heavy chain CDR2
IWYDGRNK

SEQ ID NO: 11151 - protein, 8 aa, Homo sapiens
  Heavy chain CDR2
IWYDGRNK

SEQ ID NO: 11152 - protein, 8 aa, Homo sapiens
  Heavy chain CDR2
INWNGGTT

SEQ ID NO: 11153 - protein, 8 aa, Homo sapiens
  Heavy chain CDR2
IWYDGSNK

SEQ ID NO: 11154 - protein, 8 aa, Homo sapiens
  Heavy chain CDR2
IWYDGSNK

SEQ ID NO: 11155 - protein, 8 aa, Homo sapiens
  Heavy chain CDR2
IWYDGRNK

SEQ ID NO: 11156 - protein, 8 aa, Homo sapiens
  Heavy chain CDR2
INWNGGST

SEQ ID NO: 11157 - protein, 8 aa, Homo sapiens
  Heavy chain CDR2
INWNGGST

SEQ ID NO: 11158 - protein, 8 aa, Homo sapiens
  Heavy chain CDR2
IWYDGSNK

SEQ ID NO: 11159 - protein, 8 aa, Homo sapiens
  Heavy chain CDR2
ISAYNGNT

SEQ ID NO: 11160 - protein, 10 aa, Homo sapiens
  Heavy chain CDR2
IKSKTDGGTI

SEQ ID NO: 11161 - protein, 8 aa, Homo sapiens
  Heavy chain CDR2
VNPSGGTS

SEQ ID NO: 11162 - protein, 8 aa, Homo sapiens
  Heavy chain CDR2
VNPSSGST

SEQ ID NO: 11163 - protein, 8 aa, Homo sapiens
  Heavy chain CDR2
ISVYNGNT

SEQ ID NO: 11164 - protein, 8 aa, Homo sapiens
  Heavy chain CDR2
IWYDGRNK

SEQ ID NO: 11165 - protein, 8 aa, Homo sapiens
  Heavy chain CDR2
IFYDGSNN

SEQ ID NO: 11166 - protein, 8 aa, Homo sapiens
  Heavy chain CDR2
INWNGGNT

SEQ ID NO: 11167 - protein, 8 aa, Homo sapiens
  Heavy chain CDR2
VNPSSGST

SEQ ID NO: 11168 - protein, 8 aa, Homo sapiens
  Heavy chain CDR2
INWNGGNT

SEQ ID NO: 11169 - protein, 8 aa, Homo sapiens
  Heavy chain CDR2
ISAYNGNT

SEQ ID NO: 11170 - protein, 8 aa, Homo sapiens
  Heavy chain CDR2
INPSGGST

SEQ ID NO: 11171 - protein, 8 aa, Homo sapiens
  Heavy chain CDR2
IWNDGSNR

SEQ ID NO: 11172 - protein, 8 aa, Homo sapiens
  Heavy chain CDR2
IWYDGNHK

SEQ ID NO: 11173 - protein, 8 aa, Homo sapiens
  Heavy chain CDR2
IWYDGRNK

SEQ ID NO: 11174 - protein, 8 aa, Homo sapiens
  Heavy chain CDR2
INWNGGST

SEQ ID NO: 11175 - protein, 8 aa, Homo sapiens
  Heavy chain CDR2
INWNGGNT

SEQ ID NO: 11176 - protein, 8 aa, Homo sapiens
  Heavy chain CDR2
IWYDGTIK

SEQ ID NO: 11177 - protein, 8 aa, Homo sapiens
  Heavy chain CDR2
TWYDGSNK

SEQ ID NO: 11178 - protein, 8 aa, Homo sapiens
  Heavy chain CDR2
INWNGGNT

SEQ ID NO: 11179 - protein, 8 aa, Homo sapiens
  Heavy chain CDR2
IWYDGRNK

SEQ ID NO: 11180 - protein, 8 aa, Homo sapiens
  Heavy chain CDR2
INPSGGSS

SEQ ID NO: 11181 - protein, 8 aa, Homo sapiens
  Heavy chain CDR2
IWYDGRNK

SEQ ID NO: 11182 - protein, 8 aa, Homo sapiens
  Heavy chain CDR2
IWYDGRNK

SEQ ID NO: 11183 - protein, 8 aa, Homo sapiens
  Heavy chain CDR2
IWYDGNNK

SEQ ID NO: 11184 - protein, 8 aa, Homo sapiens
  Heavy chain CDR2
ISAYNGNT

SEQ ID NO: 11185 - protein, 8 aa, Homo sapiens
  Heavy chain CDR2
INWNGGNT

SEQ ID NO: 11186 - protein, 8 aa, Homo sapiens
  Heavy chain CDR2
ISVYNGNT

SEQ ID NO: 11187 - protein, 8 aa, Homo sapiens
  Heavy chain CDR2
IFYDGSNN

SEQ ID NO: 11188 - protein, 8 aa, Homo sapiens
  Heavy chain CDR2
IWYDGRNK

SEQ ID NO: 11189 - protein, 8 aa, Homo sapiens
  Heavy chain CDR2
INWNGGNT

SEQ ID NO: 11190 - protein, 8 aa, Homo sapiens
  Heavy chain CDR2
INWNGGST

SEQ ID NO: 11191 - protein, 8 aa, Homo sapiens
  Heavy chain CDR2
INPSSGGS

SEQ ID NO: 11192 - protein, 8 aa, Homo sapiens
  Heavy chain CDR2
IWYDGNNK

SEQ ID NO: 11193 - protein, 8 aa, Homo sapiens
  Heavy chain CDR2
IWNDGSNK

SEQ ID NO: 11194 - protein, 8 aa, Homo sapiens
  Heavy chain CDR2
IWYDGRNK

SEQ ID NO: 11195 - protein, 8 aa, Homo sapiens
  Heavy chain CDR2
ISAYNGNT

SEQ ID NO: 11196 - protein, 8 aa, Homo sapiens
  Heavy chain CDR2
IWYDGNNK

SEQ ID NO: 11197 - protein, 8 aa, Homo sapiens
  Heavy chain CDR2
INWNGGST

SEQ ID NO: 11198 - protein, 8 aa, Homo sapiens
  Heavy chain CDR2
INWNGGST

SEQ ID NO: 11199 - protein, 8 aa, Homo sapiens
  Heavy chain CDR2
INWNGGNT

SEQ ID NO: 11200 - protein, 8 aa, Homo sapiens
  Heavy chain CDR2
INWNGGST

SEQ ID NO: 11201 - protein, 8 aa, Homo sapiens
  Heavy chain CDR2
ISAYNGNT

SEQ ID NO: 11202 - protein, 8 aa, Homo sapiens
  Heavy chain CDR2
INWNGGNT

SEQ ID NO: 11203 - protein, 8 aa, Homo sapiens
  Heavy chain CDR2
INWNGGNT

SEQ ID NO: 11204 - protein, 8 aa, Homo sapiens
  Heavy chain CDR2
INWNGGNT

SEQ ID NO: 11205 - protein, 8 aa, Homo sapiens
  Heavy chain CDR2
INWNGAST

SEQ ID NO: 11206 - protein, 8 aa, Homo sapiens
  Heavy chain CDR2
INWNGGNT

SEQ ID NO: 11207 - protein, 8 aa, Homo sapiens
  Heavy chain CDR2
IWNDGSNK

SEQ ID NO: 11208 - protein, 8 aa, Homo sapiens
  Heavy chain CDR2
INWNGGNT

SEQ ID NO: 11209 - protein, 8 aa, Homo sapiens
  Heavy chain CDR2
ISVYNGNT

SEQ ID NO: 11210 - protein, 8 aa, Homo sapiens
  Heavy chain CDR2
INWNGGST

SEQ ID NO: 11211 - protein, 8 aa, Homo sapiens
  Heavy chain CDR2
IWYDGGIK

SEQ ID NO: 11212 - protein, 8 aa, Homo sapiens
  Heavy chain CDR2
ISAYNGNT

SEQ ID NO: 11213 - protein, 8 aa, Homo sapiens
  Heavy chain CDR2
INWNGGNT

SEQ ID NO: 11214 - protein, 8 aa, Homo sapiens
  Heavy chain CDR2
ISAYNGNT

SEQ ID NO: 11215 - protein, 8 aa, Homo sapiens
  Heavy chain CDR2
TWYDGSNK

SEQ ID NO: 11216 - protein, 8 aa, Homo sapiens
  Heavy chain CDR2
ISAYNGNT

SEQ ID NO: 11217 - protein, 8 aa, Homo sapiens
  Heavy chain CDR2
IWYDGSNK

SEQ ID NO: 11218 - protein, 8 aa, Homo sapiens
  Heavy chain CDR2
ILYDGNNK

SEQ ID NO: 11219 - protein, 8 aa, Homo sapiens
  Heavy chain CDR2
IWYDGSNK

SEQ ID NO: 11220 - protein, 8 aa, Homo sapiens
  Heavy chain CDR2
IWYDGSNK

SEQ ID NO: 11221 - protein, 8 aa, Homo sapiens
  Heavy chain CDR2
IWYDGNNK

SEQ ID NO: 11222 - protein, 8 aa, Homo sapiens
  Heavy chain CDR2
IWYDGNNK

SEQ ID NO: 11223 - protein, 7 aa, Homo sapiens
  Heavy chain CDR2
IHYSGRT

SEQ ID NO: 11224 - protein, 8 aa, Homo sapiens
  Heavy chain CDR2
IWYDGNNK

SEQ ID NO: 11225 - protein, 8 aa, Homo sapiens
  Heavy chain CDR2
ISAYNGNT

SEQ ID NO: 11226 - protein, 8 aa, Homo sapiens
  Heavy chain CDR2
IWYDGSNK

SEQ ID NO: 11227 - protein, 8 aa, Homo sapiens
  Heavy chain CDR2
IWYDGSNK

SEQ ID NO: 11228 - protein, 8 aa, Homo sapiens
  Heavy chain CDR2
VWYDGSNK

SEQ ID NO: 11229 - protein, 8 aa, Homo sapiens
  Heavy chain CDR2
VWYDGSNK

SEQ ID NO: 11230 - protein, 8 aa, Homo sapiens
  Heavy chain CDR2
IWYDGSNR

SEQ ID NO: 11231 - protein, 8 aa, Homo sapiens
  Heavy chain CDR2
VWYDGSNK

SEQ ID NO: 11232 - protein, 8 aa, Homo sapiens
  Heavy chain CDR2
ISAYNGNT

SEQ ID NO: 11233 - protein, 8 aa, Homo sapiens
  Heavy chain CDR2
ISAYNGNT

SEQ ID NO: 11234 - protein, 8 aa, Homo sapiens
  Heavy chain CDR2
ISAYNGNT

SEQ ID NO: 11235 - protein, 8 aa, Homo sapiens
  Heavy chain CDR2
ISAYNGNT

SEQ ID NO: 11236 - protein, 8 aa, Homo sapiens
  Heavy chain CDR2
ISAYNGNT

SEQ ID NO: 11237 - protein, 8 aa, Homo sapiens
  Heavy chain CDR2
IWYDGRNK

SEQ ID NO: 11238 - protein, 8 aa, Homo sapiens
  Heavy chain CDR2
IWYDGSNK

SEQ ID NO: 11239 - protein, 8 aa, Homo sapiens
  Heavy chain CDR2
IWYDGSNK

SEQ ID NO: 11240 - protein, 8 aa, Homo sapiens
  Heavy chain CDR2
ISAYNGNT

SEQ ID NO: 11241 - protein, 8 aa, Homo sapiens
  Heavy chain CDR2
ISAYNGNT

SEQ ID NO: 11242 - protein, 8 aa, Homo sapiens
  Heavy chain CDR2
ISAYNGNT

SEQ ID NO: 11243 - protein, 8 aa, Homo sapiens
  Heavy chain CDR2
ISAYNGNT

SEQ ID NO: 11244 - protein, 8 aa, Homo sapiens
  Heavy chain CDR2
ILYDGNNK

SEQ ID NO: 11245 - protein, 8 aa, Homo sapiens
  Heavy chain CDR2
ISAYNGNT

SEQ ID NO: 11246 - protein, 8 aa, Homo sapiens
  Heavy chain CDR2
VWYDGSNK

SEQ ID NO: 11247 - protein, 8 aa, Homo sapiens
  Heavy chain CDR2
TWYDGSNK

SEQ ID NO: 11248 - protein, 8 aa, Homo sapiens
  Heavy chain CDR2
ISAYNGNT

SEQ ID NO: 11249 - protein, 8 aa, Homo sapiens
  Heavy chain CDR2
TWYDGSNK

SEQ ID NO: 11250 - protein, 8 aa, Homo sapiens
  Heavy chain CDR2
ISAYNGNT

SEQ ID NO: 11251 - protein, 8 aa, Homo sapiens
  Heavy chain CDR2
IWYDGSNK

SEQ ID NO: 11252 - protein, 8 aa, Homo sapiens
  Heavy chain CDR2
IWYDGSNK

SEQ ID NO: 11253 - protein, 8 aa, Homo sapiens
  Heavy chain CDR2
IWYDGSNK

SEQ ID NO: 11254 - protein, 8 aa, Homo sapiens
  Heavy chain CDR2
IWYDGSNK

SEQ ID NO: 11255 - protein, 8 aa, Homo sapiens
  Heavy chain CDR2
IWYDGNNK

SEQ ID NO: 11256 - protein, 8 aa, Homo sapiens
  Heavy chain CDR2
IWYEGRNK

SEQ ID NO: 11257 - protein, 8 aa, Homo sapiens
  Heavy chain CDR2
IWYDGSNK

SEQ ID NO: 11258 - protein, 8 aa, Homo sapiens
  Heavy chain CDR2
TWYDGSNK

SEQ ID NO: 11259 - protein, 8 aa, Homo sapiens
  Heavy chain CDR2
TWYDGRNK

SEQ ID NO: 11260 - protein, 8 aa, Homo sapiens
  Heavy chain CDR2
IWYDGSNK

SEQ ID NO: 11261 - protein, 8 aa, Homo sapiens
  Heavy chain CDR2
IWYDGSNK

SEQ ID NO: 11262 - protein, 8 aa, Homo sapiens
  Heavy chain CDR2
TWYDGSNK

SEQ ID NO: 11263 - protein, 8 aa, Homo sapiens
  Heavy chain CDR2
IWYDGSNK

SEQ ID NO: 11264 - protein, 8 aa, Homo sapiens
  Heavy chain CDR2
TWYDGSNK

SEQ ID NO: 11265 - protein, 8 aa, Homo sapiens
  Heavy chain CDR2
IWYDGSNK

SEQ ID NO: 11266 - protein, 8 aa, Homo sapiens
  Heavy chain CDR2
IWYDGNNK

SEQ ID NO: 11267 - protein, 8 aa, Homo sapiens
  Heavy chain CDR2
VWYDGNNK

SEQ ID NO: 11268 - protein, 8 aa, Homo sapiens
  Heavy chain CDR2
IWYDGSNK

SEQ ID NO: 11269 - protein, 8 aa, Homo sapiens
  Heavy chain CDR2
TWYDGSNK

SEQ ID NO: 11270 - protein, 8 aa, Homo sapiens
  Heavy chain CDR2
IWYDGSNK

SEQ ID NO: 11271 - protein, 8 aa, Homo sapiens
  Heavy chain CDR2
IWYEGSNK

SEQ ID NO: 11272 - protein, 8 aa, Homo sapiens
  Heavy chain CDR2
KWYDGSNK

SEQ ID NO: 11273 - protein, 8 aa, Homo sapiens
  Heavy chain CDR2
IWYDGSNK

SEQ ID NO: 11274 - protein, 8 aa, Homo sapiens
  Heavy chain CDR2
TWYDGNNK

SEQ ID NO: 11275 - protein, 8 aa, Homo sapiens
  Heavy chain CDR2
IWYDGSNK

SEQ ID NO: 11276 - protein, 8 aa, Homo sapiens
  Heavy chain CDR2
IWYDGSNK

SEQ ID NO: 11277 - protein, 8 aa, Homo sapiens
  Heavy chain CDR2
TWYNGRNK

SEQ ID NO: 11278 - protein, 8 aa, Homo sapiens
  Heavy chain CDR2
VWYDGNNK

SEQ ID NO: 11279 - protein, 8 aa, Homo sapiens
  Heavy chain CDR2
VWYDGNNK

SEQ ID NO: 11280 - protein, 7 aa, Homo sapiens
  Heavy chain CDR2
IHYSGRT

SEQ ID NO: 11281 - protein, 8 aa, Homo sapiens
  Heavy chain CDR2
IWYDGSNK

SEQ ID NO: 11282 - protein, 8 aa, Homo sapiens
  Heavy chain CDR2
ISGSGGGT

SEQ ID NO: 11283 - protein, 8 aa, Homo sapiens
  Heavy chain CDR2
TWYNGRNK

SEQ ID NO: 11284 - protein, 8 aa, Homo sapiens
  Heavy chain CDR2
ISYDGSKK

SEQ ID NO: 11285 - protein, 8 aa, Homo sapiens
  Heavy chain CDR2
TWYDGRNK

SEQ ID NO: 11286 - protein, 8 aa, Homo sapiens
  Heavy chain CDR2
IWYDGSNK

SEQ ID NO: 11287 - protein, 8 aa, Homo sapiens
  Heavy chain CDR2
TWYDGSNK

SEQ ID NO: 11288 - protein, 7 aa, Homo sapiens
  Heavy chain CDR2
IYYSGRT

SEQ ID NO: 11289 - protein, 8 aa, Homo sapiens
  Heavy chain CDR2
IWYDGSNK

SEQ ID NO: 11290 - protein, 8 aa, Homo sapiens
  Heavy chain CDR2
IWYDGRNK

SEQ ID NO: 11291 - protein, 8 aa, Homo sapiens
  Heavy chain CDR2
ISYDGSNK

SEQ ID NO: 11292 - protein, 8 aa, Homo sapiens
  Heavy chain CDR2
ISYDGSHK

SEQ ID NO: 11293 - protein, 8 aa, Homo sapiens
  Heavy chain CDR2
ISYDGSNK

SEQ ID NO: 11294 - protein, 8 aa, Homo sapiens
  Heavy chain CDR2
IKQDGSEK

SEQ ID NO: 11295 - protein, 8 aa, Homo sapiens
  Heavy chain CDR2
IWYDGNNK

SEQ ID NO: 11296 - protein, 7 aa, Homo sapiens
  Heavy chain CDR2
IYYSGST

SEQ ID NO: 11297 - protein, 8 aa, Homo sapiens
  Heavy chain CDR2
IWYDGSNK

SEQ ID NO: 11298 - protein, 8 aa, Homo sapiens
  Heavy chain CDR2
IWYDGSNK

SEQ ID NO: 11299 - protein, 8 aa, Homo sapiens
  Heavy chain CDR2
IWYDGNNK

SEQ ID NO: 11300 - protein, 8 aa, Homo sapiens
  Heavy chain CDR2
ISAYNGNT

SEQ ID NO: 11301 - protein, 8 aa, Homo sapiens
  Heavy chain CDR2
VWYDGNNK

SEQ ID NO: 11302 - protein, 8 aa, Homo sapiens
  Heavy chain CDR2
IWYDGSNK

SEQ ID NO: 11303 - protein, 8 aa, Homo sapiens
  Heavy chain CDR2
IWYDGNNK

SEQ ID NO: 11304 - protein, 8 aa, Homo sapiens
  Heavy chain CDR2
ISVYNGNT

SEQ ID NO: 11305 - protein, 8 aa, Homo sapiens
  Heavy chain CDR2
LWYDGSNN

SEQ ID NO: 11306 - protein, 8 aa, Homo sapiens
  Heavy chain CDR2
VWYDGNNK

SEQ ID NO: 11307 - protein, 9 aa, Homo sapiens
  Heavy chain CDR2
TYYRSKWYN

SEQ ID NO: 11308 - protein, 10 aa, Homo sapiens
  Heavy chain CDR2
IRSKTYGGTT

SEQ ID NO: 11309 - protein, 8 aa, Homo sapiens
  Heavy chain CDR2
IWYDGSNK

SEQ ID NO: 11310 - protein, 8 aa, Homo sapiens
  Heavy chain CDR2
ISAYNGNT

SEQ ID NO: 11311 - protein, 8 aa, Homo sapiens
  Heavy chain CDR2
TWYDGSNK

SEQ ID NO: 11312 - protein, 8 aa, Homo sapiens
  Heavy chain CDR2
IWYDGNNK

SEQ ID NO: 11313 - protein, 7 aa, Homo sapiens
  Heavy chain CDR2
IYHSGST

SEQ ID NO: 11314 - protein, 8 aa, Homo sapiens
  Heavy chain CDR2
IWYDGSNK

SEQ ID NO: 11315 - protein, 8 aa, Homo sapiens
  Heavy chain CDR2
TWYDGSNK

SEQ ID NO: 11316 - protein, 8 aa, Homo sapiens
  Heavy chain CDR2
TWYDGRNK

SEQ ID NO: 11317 - protein, 8 aa, Homo sapiens
  Heavy chain CDR2
TWYDGSNK

SEQ ID NO: 11318 - protein, 8 aa, Homo sapiens
  Heavy chain CDR2
IWYDGSNK

SEQ ID NO: 11319 - protein, 8 aa, Homo sapiens
  Heavy chain CDR2
ISYDGSHK

SEQ ID NO: 11320 - protein, 8 aa, Homo sapiens
  Heavy chain CDR2
TWYNGRNK

SEQ ID NO: 11321 - protein, 8 aa, Homo sapiens
  Heavy chain CDR2
MWYDGSNK

SEQ ID NO: 11322 - protein, 8 aa, Homo sapiens
  Heavy chain CDR2
IWYDGSNK

SEQ ID NO: 11323 - protein, 8 aa, Homo sapiens
  Heavy chain CDR2
IWYDGSNK

SEQ ID NO: 11324 - protein, 8 aa, Homo sapiens
  Heavy chain CDR2
ISAYNGNT

SEQ ID NO: 11325 - protein, 8 aa, Homo sapiens
  Heavy chain CDR2
IWYDGSNK

SEQ ID NO: 11326 - protein, 8 aa, Homo sapiens
  Heavy chain CDR2
TWYDGSNK

SEQ ID NO: 11327 - protein, 8 aa, Homo sapiens
  Heavy chain CDR2
IWYDGSNK

SEQ ID NO: 11328 - protein, 8 aa, Homo sapiens
  Heavy chain CDR2
IWYDGSNK

SEQ ID NO: 11329 - protein, 8 aa, Homo sapiens
  Heavy chain CDR2
IWYDGSNK

SEQ ID NO: 11330 - protein, 8 aa, Homo sapiens
  Heavy chain CDR2
IWYDGSNK

SEQ ID NO: 11331 - protein, 8 aa, Homo sapiens
  Heavy chain CDR2
IWYDGSNK

SEQ ID NO: 11332 - protein, 8 aa, Homo sapiens
  Heavy chain CDR2
IWYDGSNK

SEQ ID NO: 11333 - protein, 8 aa, Homo sapiens
  Heavy chain CDR2
IWYDGSNK

SEQ ID NO: 11334 - protein, 8 aa, Homo sapiens
  Heavy chain CDR2
MWYDGSNK

SEQ ID NO: 11335 - protein, 8 aa, Homo sapiens
  Heavy chain CDR2
IWYDGSNK

SEQ ID NO: 11336 - protein, 8 aa, Homo sapiens
  Heavy chain CDR2
IWYDGSNK

SEQ ID NO: 11337 - protein, 8 aa, Homo sapiens
  Heavy chain CDR2
VWYDGNHK

SEQ ID NO: 11338 - protein, 8 aa, Homo sapiens
  Heavy chain CDR2
IWYDGSNK

SEQ ID NO: 11339 - protein, 8 aa, Homo sapiens
  Heavy chain CDR2
IWYDGNNR

SEQ ID NO: 11340 - protein, 8 aa, Homo sapiens
  Heavy chain CDR2
IWYDGSNK

SEQ ID NO: 11341 - protein, 8 aa, Homo sapiens
  Heavy chain CDR2
TWYDGSNK

SEQ ID NO: 11342 - protein, 8 aa, Homo sapiens
  Heavy chain CDR2
IWYDGSNK

SEQ ID NO: 11343 - protein, 8 aa, Homo sapiens
  Heavy chain CDR2
IWYDGSNK

SEQ ID NO: 11344 - protein, 8 aa, Homo sapiens
  Heavy chain CDR2
IWYDGSNK

SEQ ID NO: 11345 - protein, 8 aa, Homo sapiens
  Heavy chain CDR2
IWYDGSNK

SEQ ID NO: 11346 - protein, 8 aa, Homo sapiens
  Heavy chain CDR2
TWYDGSNK

SEQ ID NO: 11347 - protein, 8 aa, Homo sapiens
  Heavy chain CDR2
TWYDGSNK

SEQ ID NO: 11348 - protein, 8 aa, Homo sapiens
  Heavy chain CDR2
IWYDGSNK

SEQ ID NO: 11349 - protein, 8 aa, Homo sapiens
  Heavy chain CDR2
TWYDGSNK

SEQ ID NO: 11350 - protein, 8 aa, Homo sapiens
  Heavy chain CDR2
IWYDGRNK

SEQ ID NO: 11351 - protein, 8 aa, Homo sapiens
  Heavy chain CDR2
IWYDGRNK

SEQ ID NO: 11352 - protein, 8 aa, Homo sapiens
  Heavy chain CDR2
NWYDGSNK

SEQ ID NO: 11353 - protein, 8 aa, Homo sapiens
  Heavy chain CDR2
IWYEGRNK

SEQ ID NO: 11354 - protein, 8 aa, Homo sapiens
  Heavy chain CDR2
ISAYNGNT

SEQ ID NO: 11355 - protein, 8 aa, Homo sapiens
  Heavy chain CDR2
IWYDGSNK

SEQ ID NO: 11356 - protein, 8 aa, Homo sapiens
  Heavy chain CDR2
ISGGGLST

SEQ ID NO: 11357 - protein, 8 aa, Homo sapiens
  Heavy chain CDR2
IWYDGRNK

SEQ ID NO: 11358 - protein, 8 aa, Homo sapiens
  Heavy chain CDR2
IWYDGSNK

SEQ ID NO: 11359 - protein, 8 aa, Homo sapiens
  Heavy chain CDR2
IWYEGSNK

SEQ ID NO: 11360 - protein, 8 aa, Homo sapiens
  Heavy chain CDR2
IWYEGRNK

SEQ ID NO: 11361 - protein, 8 aa, Homo sapiens
  Heavy chain CDR2
ISGSGGST

SEQ ID NO: 11362 - protein, 8 aa, Homo sapiens
  Heavy chain CDR2
IWYDGSNK

SEQ ID NO: 11363 - protein, 8 aa, Homo sapiens
  Heavy chain CDR2
IWYDGSNK

SEQ ID NO: 11364 - protein, 8 aa, Homo sapiens
  Heavy chain CDR2
ISVYNGNT

SEQ ID NO: 11365 - protein, 8 aa, Homo sapiens
  Heavy chain CDR2
IWYDGRNK

SEQ ID NO: 11366 - protein, 8 aa, Homo sapiens
  Heavy chain CDR2
IWYDGSNR

SEQ ID NO: 11367 - protein, 8 aa, Homo sapiens
  Heavy chain CDR2
IWYEGSNK

SEQ ID NO: 11368 - protein, 8 aa, Homo sapiens
  Heavy chain CDR2
IWYDGSYK

SEQ ID NO: 11369 - protein, 8 aa, Homo sapiens
  Heavy chain CDR2
ISAYNGNT

SEQ ID NO: 11370 - protein, 8 aa, Homo sapiens
  Heavy chain CDR2
ISAYNGNT

SEQ ID NO: 11371 - protein, 8 aa, Homo sapiens
  Heavy chain CDR2
IWYDGNNK

SEQ ID NO: 11372 - protein, 8 aa, Homo sapiens
  Heavy chain CDR2
IWYDGNNK

SEQ ID NO: 11373 - protein, 8 aa, Homo sapiens
  Heavy chain CDR2
IWYDGSNR

SEQ ID NO: 11374 - protein, 8 aa, Homo sapiens
  Heavy chain CDR2
ISAYNGNT

SEQ ID NO: 11375 - protein, 8 aa, Homo sapiens
  Heavy chain CDR2
IWYDGRNK

SEQ ID NO: 11376 - protein, 8 aa, Homo sapiens
  Heavy chain CDR2
IWYDGRNK

SEQ ID NO: 11377 - protein, 8 aa, Homo sapiens
  Heavy chain CDR2
IWYDGSNK

SEQ ID NO: 11378 - protein, 8 aa, Homo sapiens
  Heavy chain CDR2
SWYDGSNK

SEQ ID NO: 11379 - protein, 8 aa, Homo sapiens
  Heavy chain CDR2
IWYDGRNK

SEQ ID NO: 11380 - protein, 8 aa, Homo sapiens
  Heavy chain CDR2
ISAYNGNT

SEQ ID NO: 11381 - protein, 8 aa, Homo sapiens
  Heavy chain CDR2
ISAYNGNT

SEQ ID NO: 11382 - protein, 8 aa, Homo sapiens
  Heavy chain CDR2
IWYDGSNK

SEQ ID NO: 11383 - protein, 8 aa, Homo sapiens
  Heavy chain CDR2
IWYDGRNK

SEQ ID NO: 11384 - protein, 8 aa, Homo sapiens
  Heavy chain CDR2
VLYDGNNK

SEQ ID NO: 11385 - protein, 8 aa, Homo sapiens
  Heavy chain CDR2
IWYDGRNK

SEQ ID NO: 11386 - protein, 8 aa, Homo sapiens
  Heavy chain CDR2
IWYDGSNK

SEQ ID NO: 11387 - protein, 8 aa, Homo sapiens
  Heavy chain CDR2
ISAYNGNT

SEQ ID NO: 11388 - protein, 8 aa, Homo sapiens
  Heavy chain CDR2
IWYDGRNK

SEQ ID NO: 11389 - protein, 8 aa, Homo sapiens
  Heavy chain CDR2
IWYDGNNK

SEQ ID NO: 11390 - protein, 8 aa, Homo sapiens
  Heavy chain CDR2
IWYDGRNK

SEQ ID NO: 11391 - protein, 8 aa, Homo sapiens
  Heavy chain CDR2
IWYDGNNK

SEQ ID NO: 11392 - protein, 8 aa, Homo sapiens
  Heavy chain CDR2
IWYDVGNK

SEQ ID NO: 11393 - protein, 8 aa, Homo sapiens
  Heavy chain CDR2
IWYDGSNK

SEQ ID NO: 11394 - protein, 8 aa, Homo sapiens
  Heavy chain CDR2
ISAYNGNT

SEQ ID NO: 11395 - protein, 8 aa, Homo sapiens
  Heavy chain CDR2
IWYDGINK

SEQ ID NO: 11396 - protein, 8 aa, Homo sapiens
  Heavy chain CDR2
IWYDGRNK

SEQ ID NO: 11397 - protein, 8 aa, Homo sapiens
  Heavy chain CDR2
ISVYNGNT

SEQ ID NO: 11398 - protein, 8 aa, Homo sapiens
  Heavy chain CDR2
SWYDGSNK

SEQ ID NO: 11399 - protein, 8 aa, Homo sapiens
  Heavy chain CDR2
IWYDGSNK

SEQ ID NO: 11400 - protein, 8 aa, Homo sapiens
  Heavy chain CDR2
ISVYNGNT

SEQ ID NO: 11401 - protein, 8 aa, Homo sapiens
  Heavy chain CDR2
ISAYNGNT

SEQ ID NO: 11402 - protein, 8 aa, Homo sapiens
  Heavy chain CDR2
IWYDGRNK

SEQ ID NO: 11403 - protein, 8 aa, Homo sapiens
  Heavy chain CDR2
NWYDGSNK

SEQ ID NO: 11404 - protein, 8 aa, Homo sapiens
  Heavy chain CDR2
IWYDGSNK

SEQ ID NO: 11405 - protein, 8 aa, Homo sapiens
  Heavy chain CDR2
ISAYNGNT

SEQ ID NO: 11406 - protein, 8 aa, Homo sapiens
  Heavy chain CDR2
ISAYNGNT

SEQ ID NO: 11407 - protein, 8 aa, Homo sapiens
  Heavy chain CDR2
ISAYNGNT

SEQ ID NO: 11408 - protein, 8 aa, Homo sapiens
  Heavy chain CDR2
IWYDGNNK

SEQ ID NO: 11409 - protein, 8 aa, Homo sapiens
  Heavy chain CDR2
IWYDGRNK

SEQ ID NO: 11410 - protein, 8 aa, Homo sapiens
  Heavy chain CDR2
IWYDGSNK

SEQ ID NO: 11411 - protein, 8 aa, Homo sapiens
  Heavy chain CDR2
ISAYNGNT

SEQ ID NO: 11412 - protein, 8 aa, Homo sapiens
  Heavy chain CDR2
TWYDGSNK

SEQ ID NO: 11413 - protein, 8 aa, Homo sapiens
  Heavy chain CDR2
ISAYNGNT

SEQ ID NO: 11414 - protein, 8 aa, Homo sapiens
  Heavy chain CDR2
IWYDGSNR

SEQ ID NO: 11415 - protein, 8 aa, Homo sapiens
  Heavy chain CDR2
IWYDGRNK

SEQ ID NO: 11416 - protein, 8 aa, Homo sapiens
  Heavy chain CDR2
ISAYNGNT

SEQ ID NO: 11417 - protein, 8 aa, Homo sapiens
  Heavy chain CDR2
IWYDGRNK

SEQ ID NO: 11418 - protein, 8 aa, Homo sapiens
  Heavy chain CDR2
IWYDGSYK

SEQ ID NO: 11419 - protein, 8 aa, Homo sapiens
  Heavy chain CDR2
IWYEGRNK

SEQ ID NO: 11420 - protein, 8 aa, Homo sapiens
  Heavy chain CDR2
IWYDGRNK

SEQ ID NO: 11421 - protein, 8 aa, Homo sapiens
  Heavy chain CDR2
IWYDGRNK

SEQ ID NO: 11422 - protein, 8 aa, Homo sapiens
  Heavy chain CDR2
IWYDGSNK

SEQ ID NO: 11423 - protein, 8 aa, Homo sapiens
  Heavy chain CDR2
IWYDGRNK

SEQ ID NO: 11424 - protein, 8 aa, Homo sapiens
  Heavy chain CDR2
ISYDGSNK

SEQ ID NO: 11425 - protein, 8 aa, Homo sapiens
  Heavy chain CDR2
IWYDGRNK

SEQ ID NO: 11426 - protein, 8 aa, Homo sapiens
  Heavy chain CDR2
IWYDGRNK

SEQ ID NO: 11427 - protein, 8 aa, Homo sapiens
  Heavy chain CDR2
IWYDGRNK

SEQ ID NO: 11428 - protein, 8 aa, Homo sapiens
  Heavy chain CDR2
IWYEGRNK

SEQ ID NO: 11429 - protein, 8 aa, Homo sapiens
  Heavy chain CDR2
IWYDGRNK

SEQ ID NO: 11430 - protein, 8 aa, Homo sapiens
  Heavy chain CDR2
IWYDGSNK

SEQ ID NO: 11431 - protein, 8 aa, Homo sapiens
  Heavy chain CDR2
ISAYNGNT

SEQ ID NO: 11432 - protein, 8 aa, Homo sapiens
  Heavy chain CDR2
IWYDGRNK

SEQ ID NO: 11433 - protein, 8 aa, Homo sapiens
  Heavy chain CDR2
IWFDGNNK

SEQ ID NO: 11434 - protein, 8 aa, Homo sapiens
  Heavy chain CDR2
IWYDGRNK

SEQ ID NO: 11435 - protein, 8 aa, Homo sapiens
  Heavy chain CDR2
IWYEGRNK

SEQ ID NO: 11436 - protein, 8 aa, Homo sapiens
  Heavy chain CDR2
INPSVGST

SEQ ID NO: 11437 - protein, 8 aa, Homo sapiens
  Heavy chain CDR2
INPSVGST

SEQ ID NO: 11438 - protein, 7 aa, Homo sapiens
  Heavy chain CDR2
IYYSGST

SEQ ID NO: 11439 - protein, 8 aa, Homo sapiens
  Heavy chain CDR2
IWYDGRNK

SEQ ID NO: 11440 - protein, 8 aa, Homo sapiens
  Heavy chain CDR2
IWYDGSNK

SEQ ID NO: 11441 - protein, 8 aa, Homo sapiens
  Heavy chain CDR2
IWYEGSNK

SEQ ID NO: 11442 - protein, 8 aa, Homo sapiens
  Heavy chain CDR2
IWYDGSNK

SEQ ID NO: 11443 - protein, 8 aa, Homo sapiens
  Heavy chain CDR2
IWYDGSNK

SEQ ID NO: 11444 - protein, 8 aa, Homo sapiens
  Heavy chain CDR2
IWYDGSNK

SEQ ID NO: 11445 - protein, 8 aa, Homo sapiens
  Heavy chain CDR2
IWYDGRNK

SEQ ID NO: 11446 - protein, 8 aa, Homo sapiens
  Heavy chain CDR2
ISAYNGNT

SEQ ID NO: 11447 - protein, 8 aa, Homo sapiens
  Heavy chain CDR2
VWYDGSNK

SEQ ID NO: 11448 - protein, 8 aa, Homo sapiens
  Heavy chain CDR2
IWYDGRNK

SEQ ID NO: 11449 - protein, 8 aa, Homo sapiens
  Heavy chain CDR2
IWYDGSYT

SEQ ID NO: 11450 - protein, 8 aa, Homo sapiens
  Heavy chain CDR2
NWYDGSNK

SEQ ID NO: 11451 - protein, 8 aa, Homo sapiens
  Heavy chain CDR2
IWYDGRNK

SEQ ID NO: 11452 - protein, 8 aa, Homo sapiens
  Heavy chain CDR2
IWYDGRNK

SEQ ID NO: 11453 - protein, 7 aa, Homo sapiens
  Heavy chain CDR2
IYYRGNT

SEQ ID NO: 11454 - protein, 8 aa, Homo sapiens
  Heavy chain CDR2
IWYDGRNK

SEQ ID NO: 11455 - protein, 8 aa, Homo sapiens
  Heavy chain CDR2
ISAYNGNT

SEQ ID NO: 11456 - protein, 8 aa, Homo sapiens
  Heavy chain CDR2
IWYDGRNK

SEQ ID NO: 11457 - protein, 8 aa, Homo sapiens
  Heavy chain CDR2
ISAYNGNT

SEQ ID NO: 11458 - protein, 8 aa, Homo sapiens
  Heavy chain CDR2
IWYDGRNK

SEQ ID NO: 11459 - protein, 8 aa, Homo sapiens
  Heavy chain CDR2
IWYDGRNK

SEQ ID NO: 11460 - protein, 8 aa, Homo sapiens
  Heavy chain CDR2
IWYDGNNK

SEQ ID NO: 11461 - protein, 8 aa, Homo sapiens
  Heavy chain CDR2
IWYDGSYK

SEQ ID NO: 11462 - protein, 8 aa, Homo sapiens
  Heavy chain CDR2
IWYDGRNK

SEQ ID NO: 11463 - protein, 7 aa, Homo sapiens
  Heavy chain CDR2
IYYRGNT

SEQ ID NO: 11464 - protein, 8 aa, Homo sapiens
  Heavy chain CDR2
ISAYNGNT

SEQ ID NO: 11465 - protein, 8 aa, Homo sapiens
  Heavy chain CDR2
IWYDGRNK

SEQ ID NO: 11466 - protein, 8 aa, Homo sapiens
  Heavy chain CDR2
IWYDGRNK

SEQ ID NO: 11467 - protein, 8 aa, Homo sapiens
  Heavy chain CDR2
IWYEGRNK

SEQ ID NO: 11468 - protein, 8 aa, Homo sapiens
  Heavy chain CDR2
IWYDGSNK

SEQ ID NO: 11469 - protein, 8 aa, Homo sapiens
  Heavy chain CDR2
IWYDGRNK

SEQ ID NO: 11470 - protein, 8 aa, Homo sapiens
  Heavy chain CDR2
IWYDGRNK

SEQ ID NO: 11471 - protein, 8 aa, Homo sapiens
  Heavy chain CDR2
IWYDGRNK

SEQ ID NO: 11472 - protein, 15 aa, Homo sapiens
  Heavy chain CDR3
ARTLRYFDWLSSFDY

SEQ ID NO: 11473 - protein, 12 aa, Homo sapiens
  Heavy chain CDR3
ARRRIQLWSFDY

SEQ ID NO: 11474 - protein, 12 aa, Homo sapiens
  Heavy chain CDR3
ARRRIQLWSFDY

SEQ ID NO: 11475 - protein, 12 aa, Homo sapiens
  Heavy chain CDR3
ARRRIQLWSFDY

SEQ ID NO: 11476 - protein, 2 aa, Homo sapiens
  Heavy chain CDR3
AR

SEQ ID NO: 11477 - protein, 12 aa, Homo sapiens
  Heavy chain CDR3
ARRRIQLWSFDY

SEQ ID NO: 11478 - protein, 12 aa, Homo sapiens
  Heavy chain CDR3
ARRRIQLWSFDY

SEQ ID NO: 11479 - protein, 17 aa, Homo sapiens
  Heavy chain CDR3
AREGNWRNYYYYYGMDV

SEQ ID NO: 11480 - protein, 9 aa, Homo sapiens
  Heavy chain CDR3
TIIAAAGHY

SEQ ID NO: 11481 - protein, 8 aa, Homo sapiens
  Heavy chain CDR3
ARGWPSDY

SEQ ID NO: 11482 - protein, 12 aa, Homo sapiens
  Heavy chain CDR3
ARRRIQLWSFDY

SEQ ID NO: 11483 - protein, 13 aa, Homo sapiens
  Heavy chain CDR3
ARGDVDIVATFDY

SEQ ID NO: 11484 - protein, 12 aa, Homo sapiens
  Heavy chain CDR3
ARRRIQLWSFDY

SEQ ID NO: 11485 - protein, 17 aa, Homo sapiens
  Heavy chain CDR3
AREDNWRNYYYYYGMDV

SEQ ID NO: 11486 - protein, 12 aa, Homo sapiens
  Heavy chain CDR3
ARRRIQLWSFDY

SEQ ID NO: 11487 - protein, 12 aa, Homo sapiens
  Heavy chain CDR3
ARRRIQLWSFDY

SEQ ID NO: 11488 - protein, 18 aa, Homo sapiens
  Heavy chain CDR3
ARDQEYYYGSGSSNWFDP

SEQ ID NO: 11489 - protein, 9 aa, Homo sapiens
  Heavy chain CDR3
TIIAAAGHY

SEQ ID NO: 11490 - protein, 12 aa, Homo sapiens
  Heavy chain CDR3
ARRRIQLWSFDY

SEQ ID NO: 11491 - protein, 17 aa, Homo sapiens
  Heavy chain CDR3
AREDNWRNYYYYYGTDV

SEQ ID NO: 11492 - protein, 15 aa, Homo sapiens
  Heavy chain CDR3
ARTRRYFDWLSSFDY

SEQ ID NO: 11493 - protein, 8 aa, Homo sapiens
  Heavy chain CDR3
ARGWPSDY

SEQ ID NO: 11494 - protein, 9 aa, Homo sapiens
  Heavy chain CDR3
TIIAAAGHY

SEQ ID NO: 11495 - protein, 15 aa, Homo sapiens
  Heavy chain CDR3
ARALRYFDWLSSFDY

SEQ ID NO: 11496 - protein, 8 aa, Homo sapiens
  Heavy chain CDR3
ARRWPSDY

SEQ ID NO: 11497 - protein, 15 aa, Homo sapiens
  Heavy chain CDR3
ARPLRYFDWLSSFDY

SEQ ID NO: 11498 - protein, 17 aa, Homo sapiens
  Heavy chain CDR3
ASEDNWRNYYYYYGMDV

SEQ ID NO: 11499 - protein, 15 aa, Homo sapiens
  Heavy chain CDR3
ARPLTMVRGRAYFDY

SEQ ID NO: 11500 - protein, 17 aa, Homo sapiens
  Heavy chain CDR3
AREDNWRNYYYYYGMDV

SEQ ID NO: 11501 - protein, 15 aa, Homo sapiens
  Heavy chain CDR3
ARTLRYVDWLSSFDY

SEQ ID NO: 11502 - protein, 15 aa, Homo sapiens
  Heavy chain CDR3
ARERYSSSWYRAFDI

SEQ ID NO: 11503 - protein, 8 aa, Homo sapiens
  Heavy chain CDR3
ARGWPSDY

SEQ ID NO: 11504 - protein, 15 aa, Homo sapiens
  Heavy chain CDR3
ASTLRYFDWLSSFDY

SEQ ID NO: 11505 - protein, 15 aa, Homo sapiens
  Heavy chain CDR3
ARTVRYFDWLSSFDY

SEQ ID NO: 11506 - protein, 18 aa, Homo sapiens
  Heavy chain CDR3
ARGRAYYYGSGSYYNFDY

SEQ ID NO: 11507 - protein, 8 aa, Homo sapiens
  Heavy chain CDR3
ARGWPYDY

SEQ ID NO: 11508 - protein, 12 aa, Homo sapiens
  Heavy chain CDR3
ARRRIQLWSFDY

SEQ ID NO: 11509 - protein, 15 aa, Homo sapiens
  Heavy chain CDR3
AGTLRYFDWLSSFDY

SEQ ID NO: 11510 - protein, 9 aa, Homo sapiens
  Heavy chain CDR3
TIIAAAGHY

SEQ ID NO: 11511 - protein, 17 aa, Homo sapiens
  Heavy chain CDR3
AREDNWRNYYYSYGMDV

SEQ ID NO: 11512 - protein, 12 aa, Homo sapiens
  Heavy chain CDR3
ARRRIQLWSFDY

SEQ ID NO: 11513 - protein, 12 aa, Homo sapiens
  Heavy chain CDR3
ARRRIQLWSFDY

SEQ ID NO: 11514 - protein, 15 aa, Homo sapiens
  Heavy chain CDR3
ARTLRDFDWLSSFDY

SEQ ID NO: 11515 - protein, 12 aa, Homo sapiens
  Heavy chain CDR3
ARRRIQLWSFGY

SEQ ID NO: 11516 - protein, 17 aa, Homo sapiens
  Heavy chain CDR3
AREDNWRNYYYYYGMDV

SEQ ID NO: 11517 - protein, 17 aa, Homo sapiens
  Heavy chain CDR3
AREDNWRKYYYYYGMDV

SEQ ID NO: 11518 - protein, 12 aa, Homo sapiens
  Heavy chain CDR3
ARGDILTGYYGY

SEQ ID NO: 11519 - protein, 12 aa, Homo sapiens
  Heavy chain CDR3
VRGDILTGYYGY

SEQ ID NO: 11520 - protein, 11 aa, Homo sapiens
  Heavy chain CDR3
ARGGQLGHFDY

SEQ ID NO: 11521 - protein, 11 aa, Homo sapiens
  Heavy chain CDR3
ARVHQLGPFDY

SEQ ID NO: 11522 - protein, 11 aa, Homo sapiens
  Heavy chain CDR3
ARMVRGLIINY

SEQ ID NO: 11523 - protein, 11 aa, Homo sapiens
  Heavy chain CDR3
ARKGHLGPFDY

SEQ ID NO: 11524 - protein, 11 aa, Homo sapiens
  Heavy chain CDR3
ARGDLRGWFDP

SEQ ID NO: 11525 - protein, 14 aa, Homo sapiens
  Heavy chain CDR3
AREGGSGWYEYLDL

SEQ ID NO: 11526 - protein, 12 aa, Homo sapiens
  Heavy chain CDR3
GRGDILTGYYGY

SEQ ID NO: 11527 - protein, 11 aa, Homo sapiens
  Heavy chain CDR3
TRVDWWGVFDF

SEQ ID NO: 11528 - protein, 11 aa, Homo sapiens
  Heavy chain CDR3
ARGGQLGHFDF

SEQ ID NO: 11529 - protein, 11 aa, Homo sapiens
  Heavy chain CDR3
ARGGLIGPFDY

SEQ ID NO: 11530 - protein, 11 aa, Homo sapiens
  Heavy chain CDR3
ARAGILTGLDY

SEQ ID NO: 11531 - protein, 11 aa, Homo sapiens
  Heavy chain CDR3
ARKGHLGPFDY

SEQ ID NO: 11532 - protein, 12 aa, Homo sapiens
  Heavy chain CDR3
ARGDILTGYYSY

SEQ ID NO: 11533 - protein, 11 aa, Homo sapiens
  Heavy chain CDR3
ARVHLLGPFDY

SEQ ID NO: 11534 - protein, 13 aa, Homo sapiens
  Heavy chain CDR3
ARGLLWFGESLDY

SEQ ID NO: 11535 - protein, 11 aa, Homo sapiens
  Heavy chain CDR3
ARVPQLGPFDY

SEQ ID NO: 11536 - protein, 11 aa, Homo sapiens
  Heavy chain CDR3
TRVDWWGAFDF

SEQ ID NO: 11537 - protein, 14 aa, Homo sapiens
  Heavy chain CDR3
AREGGSGWYEYIDL

SEQ ID NO: 11538 - protein, 13 aa, Homo sapiens
  Heavy chain CDR3
SRGLLWFGESLDY

SEQ ID NO: 11539 - protein, 12 aa, Homo sapiens
  Heavy chain CDR3
ARGDILTGYYDY

SEQ ID NO: 11540 - protein, 12 aa, Homo sapiens
  Heavy chain CDR3
VRGDILTGYYSY

SEQ ID NO: 11541 - protein, 12 aa, Homo sapiens
  Heavy chain CDR3
VRGDILTGYYGY

SEQ ID NO: 11542 - protein, 11 aa, Homo sapiens
  Heavy chain CDR3
ARVHQLGPFDY

SEQ ID NO: 11543 - protein, 12 aa, Homo sapiens
  Heavy chain CDR3
VRGDILTGYYGY

SEQ ID NO: 11544 - protein, 12 aa, Homo sapiens
  Heavy chain CDR3
ARGDMLTGYYGY

SEQ ID NO: 11545 - protein, 11 aa, Homo sapiens
  Heavy chain CDR3
ARVHQLGPFDS

SEQ ID NO: 11546 - protein, 11 aa, Homo sapiens
  Heavy chain CDR3
ARVHQLGPFDY

SEQ ID NO: 11547 - protein, 12 aa, Homo sapiens
  Heavy chain CDR3
ARGDILTGYYGY

SEQ ID NO: 11548 - protein, 12 aa, Homo sapiens
  Heavy chain CDR3
ARGDILTGYYGS

SEQ ID NO: 11549 - protein, 11 aa, Homo sapiens
  Heavy chain CDR3
ARGGHLGHFDY

SEQ ID NO: 11550 - protein, 12 aa, Homo sapiens
  Heavy chain CDR3
VRGDILTGYYGY

SEQ ID NO: 11551 - protein, 11 aa, Homo sapiens
  Heavy chain CDR3
ARGGQLGHFDY

SEQ ID NO: 11552 - protein, 11 aa, Homo sapiens
  Heavy chain CDR3
ARGAILTGFDY

SEQ ID NO: 11553 - protein, 11 aa, Homo sapiens
  Heavy chain CDR3
ARKGQLGPFDY

SEQ ID NO: 11554 - protein, 12 aa, Homo sapiens
  Heavy chain CDR3
ARRSSSWYYFDY

SEQ ID NO: 11555 - protein, 14 aa, Homo sapiens
  Heavy chain CDR3
AREGGSGWYEYLDL

SEQ ID NO: 11556 - protein, 11 aa, Homo sapiens
  Heavy chain CDR3
ARKGQLGPFDY

SEQ ID NO: 11557 - protein, 11 aa, Homo sapiens
  Heavy chain CDR3
TRGDYFGFWDY

SEQ ID NO: 11558 - protein, 11 aa, Homo sapiens
  Heavy chain CDR3
ARKGQLGPFDY

SEQ ID NO: 11559 - protein, 16 aa, Homo sapiens
  Heavy chain CDR3
ARVSYYYGSGSYYFDY

SEQ ID NO: 11560 - protein, 20 aa, Homo sapiens
  Heavy chain CDR3
AGFYYGSGSRYYYYYYGMDV

SEQ ID NO: 11561 - protein, 14 aa, Homo sapiens
  Heavy chain CDR3
AREGGSGWYEYIDL

SEQ ID NO: 11562 - protein, 11 aa, Homo sapiens
  Heavy chain CDR3
ARVHQLGPFDY

SEQ ID NO: 11563 - protein, 12 aa, Homo sapiens
  Heavy chain CDR3
ARRSSSWYYFDY

SEQ ID NO: 11564 - protein, 16 aa, Homo sapiens
  Heavy chain CDR3
ARVSYYYGSGSYYFDY

SEQ ID NO: 11565 - protein, 11 aa, Homo sapiens
  Heavy chain CDR3
ARKGQLGSFDY

SEQ ID NO: 11566 - protein, 12 aa, Homo sapiens
  Heavy chain CDR3
ARRSSSWYYFDY

SEQ ID NO: 11567 - protein, 16 aa, Homo sapiens
  Heavy chain CDR3
ARVSYYYGSGSYYFDY

SEQ ID NO: 11568 - protein, 12 aa, Homo sapiens
  Heavy chain CDR3
ARRSSSWYYFYY

SEQ ID NO: 11569 - protein, 11 aa, Homo sapiens
  Heavy chain CDR3
ARGAILTGFDS

SEQ ID NO: 11570 - protein, 16 aa, Homo sapiens
  Heavy chain CDR3
ARVSYYYGSGSYYFDY

SEQ ID NO: 11571 - protein, 14 aa, Homo sapiens
  Heavy chain CDR3
ARDGGSGWYEYLDL

SEQ ID NO: 11572 - protein, 12 aa, Homo sapiens
  Heavy chain CDR3
ARRSSSWYYFDY

SEQ ID NO: 11573 - protein, 12 aa, Homo sapiens
  Heavy chain CDR3
ARRSSSWYYFDY

SEQ ID NO: 11574 - protein, 10 aa, Homo sapiens
  Heavy chain CDR3
AREKHWFFDL

SEQ ID NO: 11575 - protein, 16 aa, Homo sapiens
  Heavy chain CDR3
ARVSYYYGSGSYYFDY

SEQ ID NO: 11576 - protein, 16 aa, Homo sapiens
  Heavy chain CDR3
ARVSYSYGSGSYYFDY

SEQ ID NO: 11577 - protein, 12 aa, Homo sapiens
  Heavy chain CDR3
ARRSSGWYYFDY

SEQ ID NO: 11578 - protein, 11 aa, Homo sapiens
  Heavy chain CDR3
TRSGWYWYFDL

SEQ ID NO: 11579 - protein, 17 aa, Homo sapiens
  Heavy chain CDR3
AREDNWRNYYYYYGMDV

SEQ ID NO: 11580 - protein, 16 aa, Homo sapiens
  Heavy chain CDR3
ARVSYYYGSGSYYFDY

SEQ ID NO: 11581 - protein, 16 aa, Homo sapiens
  Heavy chain CDR3
ARVSYYYGSGSYYFDY

SEQ ID NO: 11582 - protein, 11 aa, Homo sapiens
  Heavy chain CDR3
ARGAIFTGFDY

SEQ ID NO: 11583 - protein, 20 aa, Homo sapiens
  Heavy chain CDR3
AGFYYGSGSRYYYYYYGMDV

SEQ ID NO: 11584 - protein, 16 aa, Homo sapiens
  Heavy chain CDR3
ARVSYYYGSGSYYFDY

SEQ ID NO: 11585 - protein, 11 aa, Homo sapiens
  Heavy chain CDR3
ARKGQLGPFDY

SEQ ID NO: 11586 - protein, 11 aa, Homo sapiens
  Heavy chain CDR3
ARGAILTGFDV

SEQ ID NO: 11587 - protein, 12 aa, Homo sapiens
  Heavy chain CDR3
ARGSSRYWYFDL

SEQ ID NO: 11588 - protein, 12 aa, Homo sapiens
  Heavy chain CDR3
ARRSSSWYYFDY

SEQ ID NO: 11589 - protein, 12 aa, Homo sapiens
  Heavy chain CDR3
ARRSSGWYYFDY

SEQ ID NO: 11590 - protein, 16 aa, Homo sapiens
  Heavy chain CDR3
ARVSYYYGSGSYYFDY

SEQ ID NO: 11591 - protein, 11 aa, Homo sapiens
  Heavy chain CDR3
ARKGQLGPFDS

SEQ ID NO: 11592 - protein, 12 aa, Homo sapiens
  Heavy chain CDR3
ARRSSSWYYFDY

SEQ ID NO: 11593 - protein, 11 aa, Homo sapiens
  Heavy chain CDR3
ARKGQLGPFDS

SEQ ID NO: 11594 - protein, 16 aa, Homo sapiens
  Heavy chain CDR3
ARVSYSYGSGSYYFDY

SEQ ID NO: 11595 - protein, 12 aa, Homo sapiens
  Heavy chain CDR3
ARRSSSWYYFDY

SEQ ID NO: 11596 - protein, 12 aa, Homo sapiens
  Heavy chain CDR3
ARRSSSWYYFDY

SEQ ID NO: 11597 - protein, 16 aa, Homo sapiens
  Heavy chain CDR3
ARVSYYYGSGSYYFDY

SEQ ID NO: 11598 - protein, 20 aa, Homo sapiens
  Heavy chain CDR3
AGFYYGSGSRYYYYYYGMDV

SEQ ID NO: 11599 - protein, 11 aa, Homo sapiens
  Heavy chain CDR3
ARNGQLGPFDY

SEQ ID NO: 11600 - protein, 21 aa, Homo sapiens
  Heavy chain CDR3
AGYYYGSGSPLYYYYYYGMDV

SEQ ID NO: 11601 - protein, 11 aa, Homo sapiens
  Heavy chain CDR3
ARKGQLGPFDY

SEQ ID NO: 11602 - protein, 12 aa, Homo sapiens
  Heavy chain CDR3
ARRSSSWYYFDY

SEQ ID NO: 11603 - protein, 11 aa, Homo sapiens
  Heavy chain CDR3
ARAGNWGPFDY

SEQ ID NO: 11604 - protein, 11 aa, Homo sapiens
  Heavy chain CDR3
VRDGWELLGDY

SEQ ID NO: 11605 - protein, 11 aa, Homo sapiens
  Heavy chain CDR3
ARDGWKLLDDY

SEQ ID NO: 11606 - protein, 9 aa, Homo sapiens
  Heavy chain CDR3
ARVGPPFDY

SEQ ID NO: 11607 - protein, 11 aa, Homo sapiens
  Heavy chain CDR3
VRDGWKLLDDY

SEQ ID NO: 11608 - protein, 11 aa, Homo sapiens
  Heavy chain CDR3
ARITGPYAFDI

SEQ ID NO: 11609 - protein, 10 aa, Homo sapiens
  Heavy chain CDR3
ARVGANWFDP

SEQ ID NO: 11610 - protein, 11 aa, Homo sapiens
  Heavy chain CDR3
ARGGLIGGFDY

SEQ ID NO: 11611 - protein, 11 aa, Homo sapiens
  Heavy chain CDR3
ARGGLLGGFDY

SEQ ID NO: 11612 - protein, 16 aa, Homo sapiens
  Heavy chain CDR3
ARDPPITMVRGAPFDY

SEQ ID NO: 11613 - protein, 13 aa, Homo sapiens
  Heavy chain CDR3
ARTYNWNDVGWDY

SEQ ID NO: 11614 - protein, 11 aa, Homo sapiens
  Heavy chain CDR3
ARGGLLGGFDY

SEQ ID NO: 11615 - protein, 16 aa, Homo sapiens
  Heavy chain CDR3
ARDPPITMVRGAPFDY

SEQ ID NO: 11616 - protein, 11 aa, Homo sapiens
  Heavy chain CDR3
ARGGLTGPFDY

SEQ ID NO: 11617 - protein, 11 aa, Homo sapiens
  Heavy chain CDR3
ARGGIWGYFDY

SEQ ID NO: 11618 - protein, 11 aa, Homo sapiens
  Heavy chain CDR3
VRGGIWGYFDY

SEQ ID NO: 11619 - protein, 11 aa, Homo sapiens
  Heavy chain CDR3
ARVGLLGGMDV

SEQ ID NO: 11620 - protein, 10 aa, Homo sapiens
  Heavy chain CDR3
ARVGASGVDY

SEQ ID NO: 11621 - protein, 11 aa, Homo sapiens
  Heavy chain CDR3
ARAGNWGPFDY

SEQ ID NO: 11622 - protein, 10 aa, Homo sapiens
  Heavy chain CDR3
ARVGSSGVDY

SEQ ID NO: 11623 - protein, 12 aa, Homo sapiens
  Heavy chain CDR3
ARGPSGPYEGDY

SEQ ID NO: 11624 - protein, 11 aa, Homo sapiens
  Heavy chain CDR3
ARAGILGGMDV

SEQ ID NO: 11625 - protein, 11 aa, Homo sapiens
  Heavy chain CDR3
TRDGWRLLDDY

SEQ ID NO: 11626 - protein, 11 aa, Homo sapiens
  Heavy chain CDR3
VRDGWELLGDY

SEQ ID NO: 11627 - protein, 7 aa, Homo sapiens
  Heavy chain CDR3
TEERMDY

SEQ ID NO: 11628 - protein, 13 aa, Homo sapiens
  Heavy chain CDR3
TRTYTWNDVGWDY

SEQ ID NO: 11629 - protein, 11 aa, Homo sapiens
  Heavy chain CDR3
ARAGIWGPFDY

SEQ ID NO: 11630 - protein, 13 aa, Homo sapiens
  Heavy chain CDR3
ARTYTWNDVGWDY

SEQ ID NO: 11631 - protein, 11 aa, Homo sapiens
  Heavy chain CDR3
ARDGWRLLDDY

SEQ ID NO: 11632 - protein, 13 aa, Homo sapiens
  Heavy chain CDR3
ARTYNWNDVGWDY

SEQ ID NO: 11633 - protein, 11 aa, Homo sapiens
  Heavy chain CDR3
ARGGHYGPFDY

SEQ ID NO: 11634 - protein, 13 aa, Homo sapiens
  Heavy chain CDR3
ARTYTWNDVGWDY

SEQ ID NO: 11635 - protein, 11 aa, Homo sapiens
  Heavy chain CDR3
ARAGILGGMDV

SEQ ID NO: 11636 - protein, 21 aa, Homo sapiens
  Heavy chain CDR3
ARKGDTSNGSGSHYNEGFFDI

SEQ ID NO: 11637 - protein, 11 aa, Homo sapiens
  Heavy chain CDR3
ARGGLLGGFDY

SEQ ID NO: 11638 - protein, 11 aa, Homo sapiens
  Heavy chain CDR3
ARAGNWGPFDY

SEQ ID NO: 11639 - protein, 11 aa, Homo sapiens
  Heavy chain CDR3
ARAGNWGPFDY

SEQ ID NO: 11640 - protein, 11 aa, Homo sapiens
  Heavy chain CDR3
VRDGWRLLDDY

SEQ ID NO: 11641 - protein, 10 aa, Homo sapiens
  Heavy chain CDR3
ARVGANWFDP

SEQ ID NO: 11642 - protein, 11 aa, Homo sapiens
  Heavy chain CDR3
ARDGWELLDDY

SEQ ID NO: 11643 - protein, 11 aa, Homo sapiens
  Heavy chain CDR3
ARGGLLGGFDY

SEQ ID NO: 11644 - protein, 11 aa, Homo sapiens
  Heavy chain CDR3
ARGGLLGGFDY

SEQ ID NO: 11645 - protein, 10 aa, Homo sapiens
  Heavy chain CDR3
ARLSRAGHDY

SEQ ID NO: 11646 - protein, 11 aa, Homo sapiens
  Heavy chain CDR3
ARGGNWGPFDY

SEQ ID NO: 11647 - protein, 11 aa, Homo sapiens
  Heavy chain CDR3
ARAGNWGPFDY

SEQ ID NO: 11648 - protein, 11 aa, Homo sapiens
  Heavy chain CDR3
VRDGWELLDDY

SEQ ID NO: 11649 - protein, 11 aa, Homo sapiens
  Heavy chain CDR3
VRGGIWGNFDY

SEQ ID NO: 11650 - protein, 11 aa, Homo sapiens
  Heavy chain CDR3
ARGGIWGYFDS

SEQ ID NO: 11651 - protein, 11 aa, Homo sapiens
  Heavy chain CDR3
ARAGNWGPFDS

SEQ ID NO: 11652 - protein, 11 aa, Homo sapiens
  Heavy chain CDR3
ARDGWKLLDDY

SEQ ID NO: 11653 - protein, 11 aa, Homo sapiens
  Heavy chain CDR3
VRDGWELLGDY

SEQ ID NO: 11654 - protein, 11 aa, Homo sapiens
  Heavy chain CDR3
ARGGIWGYFDY

SEQ ID NO: 11655 - protein, 10 aa, Homo sapiens
  Heavy chain CDR3
ARVGASGVDY

SEQ ID NO: 11656 - protein, 7 aa, Homo sapiens
  Heavy chain CDR3
TEERMDY

SEQ ID NO: 11657 - protein, 16 aa, Homo sapiens
  Heavy chain CDR3
ARDPPITLVRGAPFDY

SEQ ID NO: 11658 - protein, 16 aa, Homo sapiens
  Heavy chain CDR3
ARDPPITMVRGAPFDY

SEQ ID NO: 11659 - protein, 10 aa, Homo sapiens
  Heavy chain CDR3
ARVGANWFDP

SEQ ID NO: 11660 - protein, 11 aa, Homo sapiens
  Heavy chain CDR3
ARGGLLGGFDY

SEQ ID NO: 11661 - protein, 11 aa, Homo sapiens
  Heavy chain CDR3
ARGGFFGPFDY

SEQ ID NO: 11662 - protein, 11 aa, Homo sapiens
  Heavy chain CDR3
VRDGWKLLDDY

SEQ ID NO: 11663 - protein, 16 aa, Homo sapiens
  Heavy chain CDR3
ARDPPITMVRGAPFDY

SEQ ID NO: 11664 - protein, 11 aa, Homo sapiens
  Heavy chain CDR3
ARDGWRLLDDY

SEQ ID NO: 11665 - protein, 14 aa, Homo sapiens
  Heavy chain CDR3
ARLYCSGGSCYSDY

SEQ ID NO: 11666 - protein, 16 aa, Homo sapiens
  Heavy chain CDR3
ARDPPITMVRDAPFDY

SEQ ID NO: 11667 - protein, 13 aa, Homo sapiens
  Heavy chain CDR3
TRTYTWNDVGWDY

SEQ ID NO: 11668 - protein, 21 aa, Homo sapiens
  Heavy chain CDR3
ARKGDNSYGSGSYYNEGFFDM

SEQ ID NO: 11669 - protein, 11 aa, Homo sapiens
  Heavy chain CDR3
ARVGLLGGMDV

SEQ ID NO: 11670 - protein, 11 aa, Homo sapiens
  Heavy chain CDR3
VRDGWELLGDY

SEQ ID NO: 11671 - protein, 11 aa, Homo sapiens
  Heavy chain CDR3
VRDGWKLLDDY

SEQ ID NO: 11672 - protein, 21 aa, Homo sapiens
  Heavy chain CDR3
ARKGDTSNGSGSHYNEGFFDI

SEQ ID NO: 11673 - protein, 11 aa, Homo sapiens
  Heavy chain CDR3
ARGGLLGATDY

SEQ ID NO: 11674 - protein, 11 aa, Homo sapiens
  Heavy chain CDR3
ARDGWRLLDDY

SEQ ID NO: 11675 - protein, 11 aa, Homo sapiens
  Heavy chain CDR3
ARGGLIGGFDF

SEQ ID NO: 11676 - protein, 16 aa, Homo sapiens
  Heavy chain CDR3
ARDPPITMFRGAPFDY

SEQ ID NO: 11677 - protein, 11 aa, Homo sapiens
  Heavy chain CDR3
ARVGLLGAMDV

SEQ ID NO: 11678 - protein, 11 aa, Homo sapiens
  Heavy chain CDR3
ARGGLIGGFDH

SEQ ID NO: 11679 - protein, 11 aa, Homo sapiens
  Heavy chain CDR3
VRGGIWGYFDY

SEQ ID NO: 11680 - protein, 13 aa, Homo sapiens
  Heavy chain CDR3
ARKNGYDPNGFDP

SEQ ID NO: 11681 - protein, 11 aa, Homo sapiens
  Heavy chain CDR3
VRDGWKLLDDY

SEQ ID NO: 11682 - protein, 10 aa, Homo sapiens
  Heavy chain CDR3
ARVGANWFDP

SEQ ID NO: 11683 - protein, 11 aa, Homo sapiens
  Heavy chain CDR3
ARGGFFGPFDY

SEQ ID NO: 11684 - protein, 11 aa, Homo sapiens
  Heavy chain CDR3
ARSGSLGAFDI

SEQ ID NO: 11685 - protein, 11 aa, Homo sapiens
  Heavy chain CDR3
ARDGWKLLDDY

SEQ ID NO: 11686 - protein, 11 aa, Homo sapiens
  Heavy chain CDR3
ARDGWRLLDDY

SEQ ID NO: 11687 - protein, 16 aa, Homo sapiens
  Heavy chain CDR3
ARDPPITMVRGAPFDY

SEQ ID NO: 11688 - protein, 11 aa, Homo sapiens
  Heavy chain CDR3
ARGGLLGGFDY

SEQ ID NO: 11689 - protein, 13 aa, Homo sapiens
  Heavy chain CDR3
ARTYNWNDVGWDY

SEQ ID NO: 11690 - protein, 11 aa, Homo sapiens
  Heavy chain CDR3
ARQGYMGSLDY

SEQ ID NO: 11691 - protein, 10 aa, Homo sapiens
  Heavy chain CDR3
ARVGANWFDP

SEQ ID NO: 11692 - protein, 11 aa, Homo sapiens
  Heavy chain CDR3
ARGGLLGGFDY

SEQ ID NO: 11693 - protein, 11 aa, Homo sapiens
  Heavy chain CDR3
VRDGWELLGDY

SEQ ID NO: 11694 - protein, 11 aa, Homo sapiens
  Heavy chain CDR3
ARDGWELLDDY

SEQ ID NO: 11695 - protein, 11 aa, Homo sapiens
  Heavy chain CDR3
ARDGWKLLDDY

SEQ ID NO: 11696 - protein, 11 aa, Homo sapiens
  Heavy chain CDR3
MRDGWELLGDF

SEQ ID NO: 11697 - protein, 10 aa, Homo sapiens
  Heavy chain CDR3
ARKSPWGFDY

SEQ ID NO: 11698 - protein, 11 aa, Homo sapiens
  Heavy chain CDR3
ARDGWKLLDDY

SEQ ID NO: 11699 - protein, 11 aa, Homo sapiens
  Heavy chain CDR3
ARDGWKLLDDY

SEQ ID NO: 11700 - protein, 11 aa, Homo sapiens
  Heavy chain CDR3
ARDGWKRLDDY

SEQ ID NO: 11701 - protein, 11 aa, Homo sapiens
  Heavy chain CDR3
ARDGWKLLDDS

SEQ ID NO: 11702 - protein, 11 aa, Homo sapiens
  Heavy chain CDR3
ARDGWKLLDDY

SEQ ID NO: 11703 - protein, 13 aa, Homo sapiens
  Heavy chain CDR3
ARTYTWNDVGWDY

SEQ ID NO: 11704 - protein, 11 aa, Homo sapiens
  Heavy chain CDR3
ARDGWNLLDDY

SEQ ID NO: 11705 - protein, 10 aa, Homo sapiens
  Heavy chain CDR3
ARKNRWGFDY

SEQ ID NO: 11706 - protein, 11 aa, Homo sapiens
  Heavy chain CDR3
ARDGWKLRDDY

SEQ ID NO: 11707 - protein, 21 aa, Homo sapiens
  Heavy chain CDR3
ARKGDNSYGSGSHYNEGFFDI

SEQ ID NO: 11708 - protein, 12 aa, Homo sapiens
  Heavy chain CDR3
ARGPSGPYEGDY

SEQ ID NO: 11709 - protein, 11 aa, Homo sapiens
  Heavy chain CDR3
VRDGWKLLDDY

SEQ ID NO: 11710 - protein, 10 aa, Homo sapiens
  Heavy chain CDR3
ARVGANWFDP

SEQ ID NO: 11711 - protein, 11 aa, Homo sapiens
  Heavy chain CDR3
TRGELLGYFDY

SEQ ID NO: 11712 - protein, 11 aa, Homo sapiens
  Heavy chain CDR3
ARVGRHLAFAY

SEQ ID NO: 11713 - protein, 11 aa, Homo sapiens
  Heavy chain CDR3
ARGHLLGYFDY

SEQ ID NO: 11714 - protein, 11 aa, Homo sapiens
  Heavy chain CDR3
ARGALLGAFDI

SEQ ID NO: 11715 - protein, 11 aa, Homo sapiens
  Heavy chain CDR3
ARGGLMGGFDY

SEQ ID NO: 11716 - protein, 11 aa, Homo sapiens
  Heavy chain CDR3
ARGGYFGCFDH

SEQ ID NO: 11717 - protein, 14 aa, Homo sapiens
  Heavy chain CDR3
AREKGIGWYEGMDV

SEQ ID NO: 11718 - protein, 11 aa, Homo sapiens
  Heavy chain CDR3
ARGGQLGYFDY

SEQ ID NO: 11719 - protein, 13 aa, Homo sapiens
  Heavy chain CDR3
ARGYRGSYGLFDY

SEQ ID NO: 11720 - protein, 14 aa, Homo sapiens
  Heavy chain CDR3
AKEKGIGWYEGMDV

SEQ ID NO: 11721 - protein, 11 aa, Homo sapiens
  Heavy chain CDR3
ARVGRFGEFDY

SEQ ID NO: 11722 - protein, 11 aa, Homo sapiens
  Heavy chain CDR3
TRGGYFGCFDY

SEQ ID NO: 11723 - protein, 11 aa, Homo sapiens
  Heavy chain CDR3
ARGGYLGAFDI

SEQ ID NO: 11724 - protein, 11 aa, Homo sapiens
  Heavy chain CDR3
ARGGYFGCFDY

SEQ ID NO: 11725 - protein, 11 aa, Homo sapiens
  Heavy chain CDR3
ARGGYFGCFDY

SEQ ID NO: 11726 - protein, 11 aa, Homo sapiens
  Heavy chain CDR3
ARGDLLGAFDI

SEQ ID NO: 11727 - protein, 11 aa, Homo sapiens
  Heavy chain CDR3
ARGGYFGCFDY

SEQ ID NO: 11728 - protein, 13 aa, Homo sapiens
  Heavy chain CDR3
ARLTGTTSHAFDI

SEQ ID NO: 11729 - protein, 9 aa, Homo sapiens
  Heavy chain CDR3
ARVGPSFDY

SEQ ID NO: 11730 - protein, 10 aa, Homo sapiens
  Heavy chain CDR3
ARVGVNWFDP

SEQ ID NO: 11731 - protein, 13 aa, Homo sapiens
  Heavy chain CDR3
ARLTGATSHAFDI

SEQ ID NO: 11732 - protein, 10 aa, Homo sapiens
  Heavy chain CDR3
VRVGANWFDP

SEQ ID NO: 11733 - protein, 11 aa, Homo sapiens
  Heavy chain CDR3
ARNQPLGSFDY

SEQ ID NO: 11734 - protein, 11 aa, Homo sapiens
  Heavy chain CDR3
ARGELLGYFDY

SEQ ID NO: 11735 - protein, 11 aa, Homo sapiens
  Heavy chain CDR3
ARGGYFGCFDH

SEQ ID NO: 11736 - protein, 10 aa, Homo sapiens
  Heavy chain CDR3
ARVGANWFDP

SEQ ID NO: 11737 - protein, 11 aa, Homo sapiens
  Heavy chain CDR3
ARVAGYDAFDI

SEQ ID NO: 11738 - protein, 10 aa, Homo sapiens
  Heavy chain CDR3
ARVGANWFDP

SEQ ID NO: 11739 - protein, 10 aa, Homo sapiens
  Heavy chain CDR3
ARVGANWFDP

SEQ ID NO: 11740 - protein, 11 aa, Homo sapiens
  Heavy chain CDR3
ARGALLGAFDI

SEQ ID NO: 11741 - protein, 10 aa, Homo sapiens
  Heavy chain CDR3
ARVGANWFDP

SEQ ID NO: 11742 - protein, 11 aa, Homo sapiens
  Heavy chain CDR3
ARGGYFGCFDY

SEQ ID NO: 11743 - protein, 11 aa, Homo sapiens
  Heavy chain CDR3
TRGELLGYFDY

SEQ ID NO: 11744 - protein, 17 aa, Homo sapiens
  Heavy chain CDR3
ARDPVTMVRGVHWYFDL

SEQ ID NO: 11745 - protein, 11 aa, Homo sapiens
  Heavy chain CDR3
TRGELLGYFDY

SEQ ID NO: 11746 - protein, 11 aa, Homo sapiens
  Heavy chain CDR3
ARVGRHLAFAY

SEQ ID NO: 11747 - protein, 11 aa, Homo sapiens
  Heavy chain CDR3
ARGALLGAFEI

SEQ ID NO: 11748 - protein, 11 aa, Homo sapiens
  Heavy chain CDR3
ARGELLGYFDY

SEQ ID NO: 11749 - protein, 11 aa, Homo sapiens
  Heavy chain CDR3
ARGGYFGCFDY

SEQ ID NO: 11750 - protein, 11 aa, Homo sapiens
  Heavy chain CDR3
ARGGYFGCFDY

SEQ ID NO: 11751 - protein, 11 aa, Homo sapiens
  Heavy chain CDR3
ARGALLGGFDY

SEQ ID NO: 11752 - protein, 11 aa, Homo sapiens
  Heavy chain CDR3
ARGGELGPFDY

SEQ ID NO: 11753 - protein, 11 aa, Homo sapiens
  Heavy chain CDR3
ARAGNWGAFDI

SEQ ID NO: 11754 - protein, 11 aa, Homo sapiens
  Heavy chain CDR3
ARGGLTGDFDY

SEQ ID NO: 11755 - protein, 11 aa, Homo sapiens
  Heavy chain CDR3
ARGGSYGAFDI

SEQ ID NO: 11756 - protein, 11 aa, Homo sapiens
  Heavy chain CDR3
ARGELLGYFDN

SEQ ID NO: 11757 - protein, 11 aa, Homo sapiens
  Heavy chain CDR3
ARGELLGYFDS

SEQ ID NO: 11758 - protein, 11 aa, Homo sapiens
  Heavy chain CDR3
ARGGLLGHFDY

SEQ ID NO: 11759 - protein, 11 aa, Homo sapiens
  Heavy chain CDR3
ARGELLGYFDY

SEQ ID NO: 11760 - protein, 11 aa, Homo sapiens
  Heavy chain CDR3
ARGGLLGHFDY

SEQ ID NO: 11761 - protein, 11 aa, Homo sapiens
  Heavy chain CDR3
ARGGRLGAFDY

SEQ ID NO: 11762 - protein, 11 aa, Homo sapiens
  Heavy chain CDR3
ARGGLLGYFDY

SEQ ID NO: 11763 - protein, 11 aa, Homo sapiens
  Heavy chain CDR3
ARGDLLGSFDY

SEQ ID NO: 11764 - protein, 11 aa, Homo sapiens
  Heavy chain CDR3
ARGELLGYFDY

SEQ ID NO: 11765 - protein, 11 aa, Homo sapiens
  Heavy chain CDR3
VRGELLGYFDY

SEQ ID NO: 11766 - protein, 13 aa, Homo sapiens
  Heavy chain CDR3
ARGSILAAGIFDY

SEQ ID NO: 11767 - protein, 11 aa, Homo sapiens
  Heavy chain CDR3
ARGGDWGAFDI

SEQ ID NO: 11768 - protein, 10 aa, Homo sapiens
  Heavy chain CDR3
ARSIVGAFDF

SEQ ID NO: 11769 - protein, 11 aa, Homo sapiens
  Heavy chain CDR3
ARGGLTGGFDY

SEQ ID NO: 11770 - protein, 11 aa, Homo sapiens
  Heavy chain CDR3
ARGGFFGCFDY

SEQ ID NO: 11771 - protein, 11 aa, Homo sapiens
  Heavy chain CDR3
ARGGYLGAFDI

SEQ ID NO: 11772 - protein, 11 aa, Homo sapiens
  Heavy chain CDR3
ARGSKLGPFDY

SEQ ID NO: 11773 - protein, 11 aa, Homo sapiens
  Heavy chain CDR3
ARGGYYGAFDI

SEQ ID NO: 11774 - protein, 11 aa, Homo sapiens
  Heavy chain CDR3
ARGDLLGSFDY

SEQ ID NO: 11775 - protein, 11 aa, Homo sapiens
  Heavy chain CDR3
ARGHLLGSFDY

SEQ ID NO: 11776 - protein, 13 aa, Homo sapiens
  Heavy chain CDR3
ARGYRGSYGLFDY

SEQ ID NO: 11777 - protein, 11 aa, Homo sapiens
  Heavy chain CDR3
ARGHLLGYFDY

SEQ ID NO: 11778 - protein, 17 aa, Homo sapiens
  Heavy chain CDR3
AKDLLRYFDWLLSPFDY

SEQ ID NO: 11779 - protein, 11 aa, Homo sapiens
  Heavy chain CDR3
ARGGYYGAFDI

SEQ ID NO: 11780 - protein, 17 aa, Homo sapiens
  Heavy chain CDR3
AREDDILTAYYYYGMDV

SEQ ID NO: 11781 - protein, 11 aa, Homo sapiens
  Heavy chain CDR3
ARGGYYGPFDI

SEQ ID NO: 11782 - protein, 11 aa, Homo sapiens
  Heavy chain CDR3
ARGGLMGGFDY

SEQ ID NO: 11783 - protein, 10 aa, Homo sapiens
  Heavy chain CDR3
ARSIVGAFDY

SEQ ID NO: 11784 - protein, 13 aa, Homo sapiens
  Heavy chain CDR3
ARGYSGSYGLFDY

SEQ ID NO: 11785 - protein, 11 aa, Homo sapiens
  Heavy chain CDR3
ARGGYFGCFDH

SEQ ID NO: 11786 - protein, 11 aa, Homo sapiens
  Heavy chain CDR3
ARNQPLGSFDY

SEQ ID NO: 11787 - protein, 17 aa, Homo sapiens
  Heavy chain CDR3
ARDRGTYYDYYYYGMDV

SEQ ID NO: 11788 - protein, 15 aa, Homo sapiens
  Heavy chain CDR3
ARDDDILTGLYGMDV

SEQ ID NO: 11789 - protein, 17 aa, Homo sapiens
  Heavy chain CDR3
ARDRGTYYDYYYYGMDV

SEQ ID NO: 11790 - protein, 18 aa, Homo sapiens
  Heavy chain CDR3
ARDRYYYGSGRYYRYLDL

SEQ ID NO: 11791 - protein, 14 aa, Homo sapiens
  Heavy chain CDR3
ARDRGSGNYEYFDL

SEQ ID NO: 11792 - protein, 14 aa, Homo sapiens
  Heavy chain CDR3
ARIGRIAAAGSIDY

SEQ ID NO: 11793 - protein, 11 aa, Homo sapiens
  Heavy chain CDR3
ARAGNWGAFDI

SEQ ID NO: 11794 - protein, 11 aa, Homo sapiens
  Heavy chain CDR3
ARGGLTGAFDI

SEQ ID NO: 11795 - protein, 11 aa, Homo sapiens
  Heavy chain CDR3
ARGALLGGFDY

SEQ ID NO: 11796 - protein, 9 aa, Homo sapiens
  Heavy chain CDR3
ARVGPHFDY

SEQ ID NO: 11797 - protein, 11 aa, Homo sapiens
  Heavy chain CDR3
ARGGLLGSFDY

SEQ ID NO: 11798 - protein, 12 aa, Homo sapiens
  Heavy chain CDR3
ARGANWGPHFDY

SEQ ID NO: 11799 - protein, 11 aa, Homo sapiens
  Heavy chain CDR3
ARGALLGAFDI

SEQ ID NO: 11800 - protein, 9 aa, Homo sapiens
  Heavy chain CDR3
ARGPPTLHY

SEQ ID NO: 11801 - protein, 13 aa, Homo sapiens
  Heavy chain CDR3
ARGGLWFGEFLDY

SEQ ID NO: 11802 - protein, 11 aa, Homo sapiens
  Heavy chain CDR3
VRGDLLGSFDY

SEQ ID NO: 11803 - protein, 14 aa, Homo sapiens
  Heavy chain CDR3
ARDKVLLWFGEFDY

SEQ ID NO: 11804 - protein, 11 aa, Homo sapiens
  Heavy chain CDR3
SFRYTYGPFDY

SEQ ID NO: 11805 - protein, 11 aa, Homo sapiens
  Heavy chain CDR3
VRSGLVTPFDY

SEQ ID NO: 11806 - protein, 10 aa, Homo sapiens
  Heavy chain CDR3
ARVGGATIDY

SEQ ID NO: 11807 - protein, 11 aa, Homo sapiens
  Heavy chain CDR3
ARGGLTGDFNY

SEQ ID NO: 11808 - protein, 11 aa, Homo sapiens
  Heavy chain CDR3
ARGGLLGCFDY

SEQ ID NO: 11809 - protein, 16 aa, Homo sapiens
  Heavy chain CDR3
ARGGGLLWFGGIGMDV

SEQ ID NO: 11810 - protein, 11 aa, Homo sapiens
  Heavy chain CDR3
SRGELLGYFDY

SEQ ID NO: 11811 - protein, 11 aa, Homo sapiens
  Heavy chain CDR3
TRGELLGYFDY

SEQ ID NO: 11812 - protein, 11 aa, Homo sapiens
  Heavy chain CDR3
ARGGSYGAFDI

SEQ ID NO: 11813 - protein, 11 aa, Homo sapiens
  Heavy chain CDR3
ARGELLGYLDY

SEQ ID NO: 11814 - protein, 11 aa, Homo sapiens
  Heavy chain CDR3
ARGGYFGCFDF

SEQ ID NO: 11815 - protein, 15 aa, Homo sapiens
  Heavy chain CDR3
ARDDDILTGLYGMDV

SEQ ID NO: 11816 - protein, 11 aa, Homo sapiens
  Heavy chain CDR3
ARGGYYGAFDI

SEQ ID NO: 11817 - protein, 11 aa, Homo sapiens
  Heavy chain CDR3
VRGELLGYFDN

SEQ ID NO: 11818 - protein, 11 aa, Homo sapiens
  Heavy chain CDR3
ARGGYFGCFDY

SEQ ID NO: 11819 - protein, 11 aa, Homo sapiens
  Heavy chain CDR3
ARGELLGYFDY

SEQ ID NO: 11820 - protein, 11 aa, Homo sapiens
  Heavy chain CDR3
LTVAGPHVFDY

SEQ ID NO: 11821 - protein, 11 aa, Homo sapiens
  Heavy chain CDR3
ARGGYFGCFDY

SEQ ID NO: 11822 - protein, 11 aa, Homo sapiens
  Heavy chain CDR3
TRGELLGYFDY

SEQ ID NO: 11823 - protein, 11 aa, Homo sapiens
  Heavy chain CDR3
ARGGYFGCFDY

SEQ ID NO: 11824 - protein, 11 aa, Homo sapiens
  Heavy chain CDR3
ARGSKLGPFDY

SEQ ID NO: 11825 - protein, 11 aa, Homo sapiens
  Heavy chain CDR3
ARGGYFGCFDQ

SEQ ID NO: 11826 - protein, 11 aa, Homo sapiens
  Heavy chain CDR3
ARGGYFGCFDY

SEQ ID NO: 11827 - protein, 11 aa, Homo sapiens
  Heavy chain CDR3
ARGDLLGYFDY

SEQ ID NO: 11828 - protein, 11 aa, Homo sapiens
  Heavy chain CDR3
ARGELLGYFDY

SEQ ID NO: 11829 - protein, 11 aa, Homo sapiens
  Heavy chain CDR3
ARAGNWGAFDI

SEQ ID NO: 11830 - protein, 11 aa, Homo sapiens
  Heavy chain CDR3
VRGELLGYFDN

SEQ ID NO: 11831 - protein, 11 aa, Homo sapiens
  Heavy chain CDR3
ARGGYFGCFDH

SEQ ID NO: 11832 - protein, 11 aa, Homo sapiens
  Heavy chain CDR3
ARGELLGYFDN

SEQ ID NO: 11833 - protein, 14 aa, Homo sapiens
  Heavy chain CDR3
AREKGSGWYEGMDV

SEQ ID NO: 11834 - protein, 11 aa, Homo sapiens
  Heavy chain CDR3
ARGAKLGPFDY

SEQ ID NO: 11835 - protein, 11 aa, Homo sapiens
  Heavy chain CDR3
ARGGRLGAFDY

SEQ ID NO: 11836 - protein, 11 aa, Homo sapiens
  Heavy chain CDR3
ARGGYLGAFDI

SEQ ID NO: 11837 - protein, 11 aa, Homo sapiens
  Heavy chain CDR3
TRGELLGHFDY

SEQ ID NO: 11838 - protein, 11 aa, Homo sapiens
  Heavy chain CDR3
ARGGYFGCFDP

SEQ ID NO: 11839 - protein, 11 aa, Homo sapiens
  Heavy chain CDR3
ARGGYFGCFDS

SEQ ID NO: 11840 - protein, 11 aa, Homo sapiens
  Heavy chain CDR3
ARGELLGYFDY

SEQ ID NO: 11841 - protein, 11 aa, Homo sapiens
  Heavy chain CDR3
ARGGYFGCFDY

SEQ ID NO: 11842 - protein, 11 aa, Homo sapiens
  Heavy chain CDR3
TRGELLGYVDY

SEQ ID NO: 11843 - protein, 11 aa, Homo sapiens
  Heavy chain CDR3
TRGELLGYFDY

SEQ ID NO: 11844 - protein, 11 aa, Homo sapiens
  Heavy chain CDR3
ARGGYFGCVDY

SEQ ID NO: 11845 - protein, 11 aa, Homo sapiens
  Heavy chain CDR3
TRGDLLGYFDY

SEQ ID NO: 11846 - protein, 12 aa, Homo sapiens
  Heavy chain CDR3
ARGGLLGPYFDY

SEQ ID NO: 11847 - protein, 12 aa, Homo sapiens
  Heavy chain CDR3
ARGGDWGPYFDY

SEQ ID NO: 11848 - protein, 12 aa, Homo sapiens
  Heavy chain CDR3
ARGGVWGPYFDY

SEQ ID NO: 11849 - protein, 11 aa, Homo sapiens
  Heavy chain CDR3
ARAGDLGAFDI

SEQ ID NO: 11850 - protein, 10 aa, Homo sapiens
  Heavy chain CDR3
ARVGAGDWDY

SEQ ID NO: 11851 - protein, 11 aa, Homo sapiens
  Heavy chain CDR3
ARAHYFGAFDI

SEQ ID NO: 11852 - protein, 11 aa, Homo sapiens
  Heavy chain CDR3
AKDLLWLGFDY

SEQ ID NO: 11853 - protein, 12 aa, Homo sapiens
  Heavy chain CDR3
ARGGDWGPYFDY

SEQ ID NO: 11854 - protein, 11 aa, Homo sapiens
  Heavy chain CDR3
ARNGLIGAFDI

SEQ ID NO: 11855 - protein, 11 aa, Homo sapiens
  Heavy chain CDR3
ARAGHLGAFDI

SEQ ID NO: 11856 - protein, 11 aa, Homo sapiens
  Heavy chain CDR3
ARAGDLGAFDI

SEQ ID NO: 11857 - protein, 11 aa, Homo sapiens
  Heavy chain CDR3
AKLGIAWYFDV

SEQ ID NO: 11858 - protein, 11 aa, Homo sapiens
  Heavy chain CDR3
ARAGDLAAFDI

SEQ ID NO: 11859 - protein, 11 aa, Homo sapiens
  Heavy chain CDR3
ARGGQLGPFDY

SEQ ID NO: 11860 - protein, 9 aa, Homo sapiens
  Heavy chain CDR3
ARWVRGVDY

SEQ ID NO: 11861 - protein, 12 aa, Homo sapiens
  Heavy chain CDR3
ARGEYFGEFFDY

SEQ ID NO: 11862 - protein, 11 aa, Homo sapiens
  Heavy chain CDR3
ARASLTGSFDY

SEQ ID NO: 11863 - protein, 11 aa, Homo sapiens
  Heavy chain CDR3
VRAGYLGAFDI

SEQ ID NO: 11864 - protein, 16 aa, Homo sapiens
  Heavy chain CDR3
ARAPHYAILTGYYEDY

SEQ ID NO: 11865 - protein, 13 aa, Homo sapiens
  Heavy chain CDR3
ARDYYDSSGYFDY

SEQ ID NO: 11866 - protein, 11 aa, Homo sapiens
  Heavy chain CDR3
ARVTGRDAFDI

SEQ ID NO: 11867 - protein, 13 aa, Homo sapiens
  Heavy chain CDR3
ARGGILAAGIFDY

SEQ ID NO: 11868 - protein, 15 aa, Homo sapiens
  Heavy chain CDR3
ARMLRGAPYYYGMDV

SEQ ID NO: 11869 - protein, 11 aa, Homo sapiens
  Heavy chain CDR3
ARASLTGSFDY

SEQ ID NO: 11870 - protein, 10 aa, Homo sapiens
  Heavy chain CDR3
ARVGPINLDY

SEQ ID NO: 11871 - protein, 11 aa, Homo sapiens
  Heavy chain CDR3
ARGSQLGPFDY

SEQ ID NO: 11872 - protein, 12 aa, Homo sapiens
  Heavy chain CDR3
ARGGLLGPYFDY

SEQ ID NO: 11873 - protein, 12 aa, Homo sapiens
  Heavy chain CDR3
ARGDILTGYYGY

SEQ ID NO: 11874 - protein, 12 aa, Homo sapiens
  Heavy chain CDR3
ARGGVWGSYFDY

SEQ ID NO: 11875 - protein, 12 aa, Homo sapiens
  Heavy chain CDR3
ARGGLLGPYFDY

SEQ ID NO: 11876 - protein, 10 aa, Homo sapiens
  Heavy chain CDR3
ARVGPTNLDY

SEQ ID NO: 11877 - protein, 9 aa, Homo sapiens
  Heavy chain CDR3
AKVSGYFDY

SEQ ID NO: 11878 - protein, 16 aa, Homo sapiens
  Heavy chain CDR3
ARAPHYGILTGYYEDY

SEQ ID NO: 11879 - protein, 11 aa, Homo sapiens
  Heavy chain CDR3
ARAGYLGAFDI

SEQ ID NO: 11880 - protein, 11 aa, Homo sapiens
  Heavy chain CDR3
ARGGLTGPFDY

SEQ ID NO: 11881 - protein, 11 aa, Homo sapiens
  Heavy chain CDR3
ARGGYWGSFDY

SEQ ID NO: 11882 - protein, 11 aa, Homo sapiens
  Heavy chain CDR3
ARAHYFGAFDI

SEQ ID NO: 11883 - protein, 10 aa, Homo sapiens
  Heavy chain CDR3
ARVRGGGLDV

SEQ ID NO: 11884 - protein, 11 aa, Homo sapiens
  Heavy chain CDR3
SRSGSFGAFDI

SEQ ID NO: 11885 - protein, 13 aa, Homo sapiens
  Heavy chain CDR3
ARGGILAAGIFDY

SEQ ID NO: 11886 - protein, 11 aa, Homo sapiens
  Heavy chain CDR3
ARAGELGPFDY

SEQ ID NO: 11887 - protein, 13 aa, Homo sapiens
  Heavy chain CDR3
VRGSIVAAGLFDY

SEQ ID NO: 11888 - protein, 15 aa, Homo sapiens
  Heavy chain CDR3
ARDYYGSGSPRHFDY

SEQ ID NO: 11889 - protein, 11 aa, Homo sapiens
  Heavy chain CDR3
ARVHYFGAFDI

SEQ ID NO: 11890 - protein, 10 aa, Homo sapiens
  Heavy chain CDR3
ARVAAAGFDY

SEQ ID NO: 11891 - protein, 11 aa, Homo sapiens
  Heavy chain CDR3
ARNSLLTGWDY

SEQ ID NO: 11892 - protein, 12 aa, Homo sapiens
  Heavy chain CDR3
ARGGLLGPYFDY

SEQ ID NO: 11893 - protein, 10 aa, Homo sapiens
  Heavy chain CDR3
ARLGKGLFDY

SEQ ID NO: 11894 - protein, 12 aa, Homo sapiens
  Heavy chain CDR3
ARGGVWGSYFDY

SEQ ID NO: 11895 - protein, 17 aa, Homo sapiens
  Heavy chain CDR3
ARDRYDILTGPYWYFDL

SEQ ID NO: 11896 - protein, 11 aa, Homo sapiens
  Heavy chain CDR3
ARVGVRGIFDY

SEQ ID NO: 11897 - protein, 10 aa, Homo sapiens
  Heavy chain CDR3
ARVRGGGMDV

SEQ ID NO: 11898 - protein, 12 aa, Homo sapiens
  Heavy chain CDR3
ARGGLLGPYFDY

SEQ ID NO: 11899 - protein, 12 aa, Homo sapiens
  Heavy chain CDR3
ARGGVWGPYFDY

SEQ ID NO: 11900 - protein, 13 aa, Homo sapiens
  Heavy chain CDR3
ARGGIVAAGILDY

SEQ ID NO: 11901 - protein, 9 aa, Homo sapiens
  Heavy chain CDR3
ARVAPYFDY

SEQ ID NO: 11902 - protein, 9 aa, Homo sapiens
  Heavy chain CDR3
ARFIYGMDV

SEQ ID NO: 11903 - protein, 10 aa, Homo sapiens
  Heavy chain CDR3
ARVGATNLDY

SEQ ID NO: 11904 - protein, 11 aa, Homo sapiens
  Heavy chain CDR3
ARAGHLGPFDY

SEQ ID NO: 11905 - protein, 11 aa, Homo sapiens
  Heavy chain CDR3
ARAGLLGYFDY

SEQ ID NO: 11906 - protein, 11 aa, Homo sapiens
  Heavy chain CDR3
ARGGHLGSFDY

SEQ ID NO: 11907 - protein, 10 aa, Homo sapiens
  Heavy chain CDR3
ARVRGGGVDV

SEQ ID NO: 11908 - protein, 11 aa, Homo sapiens
  Heavy chain CDR3
ARSGSFGAFDI

SEQ ID NO: 11909 - protein, 9 aa, Homo sapiens
  Heavy chain CDR3
ARLGHYIDY

SEQ ID NO: 11910 - protein, 11 aa, Homo sapiens
  Heavy chain CDR3
ARAGLWSAFDI

SEQ ID NO: 11911 - protein, 11 aa, Homo sapiens
  Heavy chain CDR3
ARQDYWGPFDY

SEQ ID NO: 11912 - protein, 10 aa, Homo sapiens
  Heavy chain CDR3
ARVGIGAFDI

SEQ ID NO: 11913 - protein, 12 aa, Homo sapiens
  Heavy chain CDR3
ARGGDWGPYFDY

SEQ ID NO: 11914 - protein, 16 aa, Homo sapiens
  Heavy chain CDR3
ASAYYDLLTGPYYFDY

SEQ ID NO: 11915 - protein, 11 aa, Homo sapiens
  Heavy chain CDR3
ARAGDLGAFDI

SEQ ID NO: 11916 - protein, 12 aa, Homo sapiens
  Heavy chain CDR3
ARGEWFGEFFDY

SEQ ID NO: 11917 - protein, 10 aa, Homo sapiens
  Heavy chain CDR3
ARSIVGAFDY

SEQ ID NO: 11918 - protein, 11 aa, Homo sapiens
  Heavy chain CDR3
ARGHYFGAFDI

SEQ ID NO: 11919 - protein, 12 aa, Homo sapiens
  Heavy chain CDR3
ARGGLLGPYFDY

SEQ ID NO: 11920 - protein, 17 aa, Homo sapiens
  Heavy chain CDR3
AREDYYGSGRNYYGMDV

SEQ ID NO: 11921 - protein, 11 aa, Homo sapiens
  Heavy chain CDR3
ARAGELGPFDY

SEQ ID NO: 11922 - protein, 11 aa, Homo sapiens
  Heavy chain CDR3
ARAHYFGAFDI

SEQ ID NO: 11923 - protein, 12 aa, Homo sapiens
  Heavy chain CDR3
ARGGDWGPYFDY

SEQ ID NO: 11924 - protein, 11 aa, Homo sapiens
  Heavy chain CDR3
ARAGDLGAFDI

SEQ ID NO: 11925 - protein, 12 aa, Homo sapiens
  Heavy chain CDR3
ARGGVWGSYFDY

SEQ ID NO: 11926 - protein, 11 aa, Homo sapiens
  Heavy chain CDR3
ARGSLLGPFDY

SEQ ID NO: 11927 - protein, 9 aa, Homo sapiens
  Heavy chain CDR3
GRWVRGVEY

SEQ ID NO: 11928 - protein, 12 aa, Homo sapiens
  Heavy chain CDR3
ARGGDWGPYFDY

SEQ ID NO: 11929 - protein, 15 aa, Homo sapiens
  Heavy chain CDR3
ARMLRGAPYYYGMDV

SEQ ID NO: 11930 - protein, 12 aa, Homo sapiens
  Heavy chain CDR3
ARGEFFGEFFDY

SEQ ID NO: 11931 - protein, 11 aa, Homo sapiens
  Heavy chain CDR3
ARAGDLGAFDI

SEQ ID NO: 11932 - protein, 16 aa, Homo sapiens
  Heavy chain CDR3
AREVRVRGVIIPFFDY

SEQ ID NO: 11933 - protein, 16 aa, Homo sapiens
  Heavy chain CDR3
AREVRVRGVIIPFFDY

SEQ ID NO: 11934 - protein, 22 aa, Homo sapiens
  Heavy chain CDR3
AGTYYYGSGSYSGYYYYYGMDV

SEQ ID NO: 11935 - protein, 12 aa, Homo sapiens
  Heavy chain CDR3
ARGGVWGSYFDY

SEQ ID NO: 11936 - protein, 11 aa, Homo sapiens
  Heavy chain CDR3
ARGGLLGPFDY

SEQ ID NO: 11937 - protein, 11 aa, Homo sapiens
  Heavy chain CDR3
ARAGLLGYFDY

SEQ ID NO: 11938 - protein, 11 aa, Homo sapiens
  Heavy chain CDR3
ARGGLIGPFDY

SEQ ID NO: 11939 - protein, 11 aa, Homo sapiens
  Heavy chain CDR3
ARGGHLGSFDY

SEQ ID NO: 11940 - protein, 11 aa, Homo sapiens
  Heavy chain CDR3
ARGGLMGAFDY

SEQ ID NO: 11941 - protein, 12 aa, Homo sapiens
  Heavy chain CDR3
ARGGDWGPYFDY

SEQ ID NO: 11942 - protein, 9 aa, Homo sapiens
  Heavy chain CDR3
GRWVRGVEY

SEQ ID NO: 11943 - protein, 11 aa, Homo sapiens
  Heavy chain CDR3
ARAGHLGPFDY

SEQ ID NO: 11944 - protein, 12 aa, Homo sapiens
  Heavy chain CDR3
ARGGLLGPYFDY

SEQ ID NO: 11945 - protein, 16 aa, Homo sapiens
  Heavy chain CDR3
ASAYYDILTGPYYFDY

SEQ ID NO: 11946 - protein, 12 aa, Homo sapiens
  Heavy chain CDR3
ARGGVWGPYFDY

SEQ ID NO: 11947 - protein, 11 aa, Homo sapiens
  Heavy chain CDR3
ARAGELGPFDY

SEQ ID NO: 11948 - protein, 12 aa, Homo sapiens
  Heavy chain CDR3
ARGGLLGPYFDY

SEQ ID NO: 11949 - protein, 13 aa, Homo sapiens
  Heavy chain CDR3
ARRSAYDPYYFDY

SEQ ID NO: 11950 - protein, 11 aa, Homo sapiens
  Heavy chain CDR3
ARGGLTGPFDY

SEQ ID NO: 11951 - protein, 9 aa, Homo sapiens
  Heavy chain CDR3
GRWVRGVEY

SEQ ID NO: 11952 - protein, 11 aa, Homo sapiens
  Heavy chain CDR3
ARAHYFGAFDI

SEQ ID NO: 11953 - protein, 9 aa, Homo sapiens
  Heavy chain CDR3
GRWVRGVEY

SEQ ID NO: 11954 - protein, 11 aa, Homo sapiens
  Heavy chain CDR3
ARAHYFGAFDI

SEQ ID NO: 11955 - protein, 12 aa, Homo sapiens
  Heavy chain CDR3
ARGGVWGSYFDY

SEQ ID NO: 11956 - protein, 13 aa, Homo sapiens
  Heavy chain CDR3
ARGGILAAGIFDY

SEQ ID NO: 11957 - protein, 13 aa, Homo sapiens
  Heavy chain CDR3
ARGSVVAAGLFDY

SEQ ID NO: 11958 - protein, 12 aa, Homo sapiens
  Heavy chain CDR3
ARGGVWGSYFDY

SEQ ID NO: 11959 - protein, 13 aa, Homo sapiens
  Heavy chain CDR3
ARRSAYDPYYFDY

SEQ ID NO: 11960 - protein, 9 aa, Homo sapiens
  Heavy chain CDR3
AKVSGYFDY

SEQ ID NO: 11961 - protein, 12 aa, Homo sapiens
  Heavy chain CDR3
ARGGVWGSYFDY

SEQ ID NO: 11962 - protein, 12 aa, Homo sapiens
  Heavy chain CDR3
ARGGDWGPYFDY

SEQ ID NO: 11963 - protein, 11 aa, Homo sapiens
  Heavy chain CDR3
ARAGDLGAFDI

SEQ ID NO: 11964 - protein, 11 aa, Homo sapiens
  Heavy chain CDR3
ARAGHLGAFDI

SEQ ID NO: 11965 - protein, 12 aa, Homo sapiens
  Heavy chain CDR3
ARGGDWGPYFDY

SEQ ID NO: 11966 - protein, 11 aa, Homo sapiens
  Heavy chain CDR3
ARAGELGPFDY

SEQ ID NO: 11967 - protein, 11 aa, Homo sapiens
  Heavy chain CDR3
ARAGELGPFDY

SEQ ID NO: 11968 - protein, 5 aa, Artificial Sequence
  Description of Artificial Sequence: Synthetic peptide
  See specification as filed for detailed description of substitutions and preferred embodiments
GGGGS

SEQ ID NO: 11969 - protein, 5 aa, Homo sapiens
CPSCP

SEQ ID NO: 11970 - protein, 5 aa, Homo sapiens
CPPCP

SEQ ID NO: 11971 - protein, 9 aa, Homo sapiens
QQRSNWPLT

SEQ ID NO: 11972 - protein, 13 aa, Homo sapiens
ARDRGASRGAFNI

SEQ ID NO: 11973 - protein, 10 aa, Homo sapiens
QQYGSSPPIT

SEQ ID NO: 11974 - protein, 11 aa, Homo sapiens
AISSWYGFFQN

SEQ ID NO: 11975 - protein, 9 aa, Homo sapiens
QQYGSSPYT

SEQ ID NO: 11976 - protein, 15 aa, Homo sapiens
AREGGAYYYFYGMDV

SEQ ID NO: 11977 - protein, 9 aa, Homo sapiens
QQRSNWPFT

SEQ ID NO: 11978 - protein, 15 aa, Homo sapiens
ARGRPTDYYYYGVDV

SEQ ID NO: 11979 - protein, 9 aa, Homo sapiens
QQANSFPLT

SEQ ID NO: 11980 - protein, 13 aa, Homo sapiens
ARDSTLGRGYFDL

SEQ ID NO: 11981 - protein, 9 aa, Homo sapiens
QQRSNWPLT

SEQ ID NO: 11982 - protein, 13 aa, Homo sapiens
ARDRGASRGAFNI

SEQ ID NO: 11983 - protein, 9 aa, Homo sapiens
QQRSNWPLT

SEQ ID NO: 11984 - protein, 11 aa, Homo sapiens
AISSWYGFFQN

SEQ ID NO: 11985 - protein, 9 aa, Homo sapiens
QQRSNWPLT

SEQ ID NO: 11986 - protein, 15 aa, Homo sapiens
AREGGAYYYFYGMDV

SEQ ID NO: 11987 - protein, 10 aa, Homo sapiens
QQYGSSPPIT

SEQ ID NO: 11988 - protein, 13 aa, Homo sapiens
ARDRGASRGAFNI

SEQ ID NO: 11989 - protein, 10 aa, Homo sapiens
QQYGSSPPIT

SEQ ID NO: 11990 - protein, 11 aa, Homo sapiens
AISSWYGFFQN

SEQ ID NO: 11991 - protein, 10 aa, Homo sapiens
QQYGSSPPIT

SEQ ID NO: 11992 - protein, 15 aa, Homo sapiens
AREGGAYYYFYGMDV

SEQ ID NO: 11993 - protein, 9 aa, Homo sapiens
QQYGSSPYT

SEQ ID NO: 11994 - protein, 13 aa, Homo sapiens
ARDRGASRGAFNI

SEQ ID NO: 11995 - protein, 9 aa, Homo sapiens
QQYGSSPYT

SEQ ID NO: 11996 - protein, 11 aa, Homo sapiens
AISSWYGFFQN

SEQ ID NO: 11997 - protein, 9 aa, Homo sapiens
QQYGSSPYT

SEQ ID NO: 11998 - protein, 15 aa, Homo sapiens
AREGGAYYYFYGMDV

What is claimed is:

1. An isolated antigen binding protein (ABP) that specifically binds a human cytotoxic T-lymphocyte associated protein 4 (CTLA-4), comprising a CDR1-L, a CDR2-L, a CDR3-L, a CDR1-H, a CDR2-H and a CDR3-H, wherein:
   the CDR1-L consists of SEQ ID NO: 1014,
   the CDR2-L consists of SEQ ID NO: 2014,
   the CDR3-L consists of SEQ ID NO: 3014,
   the CDR1-H consists of SEQ ID NO: 4014,
   the CDR2-H consists of SEQ ID NO: 5014 and
   the CDR3-H consists of SEQ ID NO: 6014.

2. The ABP of claim 1, comprising:
   a variable light chain ($V_L$) comprising a sequence at least 97% identical to a sequence of SEQ ID NO: 14 and a variable heavy chain ($V_H$) comprising a sequence at least 970 identical to a sequence of SEQ ID NO: 114.

3. The ABP of claim 1, comprising:
   a variable light chain ($V_L$) comprising a sequence of SEQ ID NO: 14 and a variable heavy chain ($V_H$) comprising a sequence of SEQ ID NO: 114.

4. The ABP of claim 1, wherein the ABP comprises an scFv or a full length monoclonal antibody.

5. The ABP of claim 1, wherein the ABP comprises an immunoglobulin constant region.

6. The ABP of claim 1, wherein the ABP binds human CTLA-4 with a $K_D$ of less than 500 nM, or with a $K_D$ of less than 200 nM, or with a $K_D$ of less than 25 nM as measured by surface plasmon resonance or wherein the ABP binds to human CTLA-4 on a cell surface with a $K_D$ of less than 25 nM.

7. A pharmaceutical composition comprising the ABP of claim 1 and an excipient.

8. A method of treating cancer in a subject, the method comprising:
   administering to the subject in need thereof an effective amount of the ABP of claim 1.

9. The method of claim 8, further comprising the step of administering one or more additional therapeutic agents to the subject.

10. The method of claim 9, wherein the additional therapeutic agent is selected from CTLA-4 inhibitor, TIGIT inhibitor, a chemotherapy agent, an immune-stimulatory agent, radiation, a cytokine, a polynucleotide encoding a cytokine and a combination thereof.

11. An isolated polynucleotide encoding the ABP of claim 1.

12. A vector comprising the isolated polynucleotide of claim 11.

13. A host cell comprising the isolated polynucleotide of claim 11.

14. A method of producing an isolated antigen binding protein (ABP) that specifically binds human CTLA-4, comprising:
   expressing the ABP in the host cell of claim 13, and isolating the ABP.

* * * * *